(12) United States Patent
Chi et al.

(10) Patent No.: US 11,447,832 B2
(45) Date of Patent: Sep. 20, 2022

(54) COMPOSITIONS AND METHODS FOR ONCOLOGY PRECISION ASSAYS

(71) Applicant: Life Technologies Corporation, Carlsbad, CA (US)

(72) Inventors: David Chi, Redwood City, CA (US); Aren Ewing, Carlsbad, CA (US); Na Li, Foster City, CA (US); Zunping Luo, Redwood City, CA (US); Amir Marcovitz, Menlo Park, CA (US)

(73) Assignee: Life Technologies Corporation, Carlsbad, CA (US)

( * ) Notice: Subject to any disclaimer, the term of this patent is extended or adjusted under 35 U.S.C. 154(b) by 0 days.

(21) Appl. No.: 16/948,046

(22) Filed: Aug. 28, 2020

(65) Prior Publication Data
US 2021/0062271 A1    Mar. 4, 2021

Related U.S. Application Data

(60) Provisional application No. 62/894,576, filed on Aug. 30, 2019.

(51) Int. Cl.
*C12Q 1/6886* (2018.01)

(52) U.S. Cl.
CPC ....... *C12Q 1/6886* (2013.01); *C12Q 2537/16* (2013.01); *C12Q 2600/118* (2013.01); *C12Q 2600/16* (2013.01)

(58) Field of Classification Search
None
See application file for complete search history.

(56) References Cited

U.S. PATENT DOCUMENTS

2015/0301058 A1\* 10/2015 Schettini ............ A61K 39/0011
424/193.1

FOREIGN PATENT DOCUMENTS

| CN | 107723354 A | 2/2018 |
|---|---|---|
| CN | 104630375 B | 10/2018 |
| WO | WO-2018090298 A2 | 5/2018 |
| WO | WO-2019067092 A1 | 4/2019 |

OTHER PUBLICATIONS

Haynes et al., "An Integrated Next-Generation Sequencing System for Analyzing DNA Mutations, Gene Fusions, and RNA Expression in Lung Cancer", Translational Oncology, vol. 12, No. 6, Jun. 1, 2019 (Jun. 1, 2019), XP055739816, pp. 836-845, ISSN: 1936-5233, DOI: 10.1016/j.tranon.2019.02.012.
Hovelson et al., "Development and Validation of a Scalable Next-Generation Sequencing System for Assessing Relevant Somatic Variants in Solid Tumors", NEOPLASIA, vol. 17, No. 4, Apr. 1, 2015 (Apr. 1, 2015), XP055595675, pp. 385-399, ISSN: 1476-5586, DOI: 10.1016/j.neo.2015.03.004.
Hovelson et al., "Development and validation of a scalable next-generation sequencing system for assessing relevant somatic variants in solid tumors Supplementary Materials Supplementary Materials and Methods pp. 1-7 Supplementary References p. 8 Supplementary Figure Legends pp. 9-12 Supplementary Figures 1-8 P", Apr. 1, 2015 (Apr. 1, 2015), XP055740074, Retrieved from the Internet: URL:https://ars.els-cdn.com/content/image/1-s2.0-S1476558615000445-mmc1.pdf [retrieved on Oct. 14, 2020].
PCT/US2020/070473, International Search Report and Written Opinion, dated Oct. 27, 2020, 14 pages.

\* cited by examiner

*Primary Examiner* — Katherine D Salmon
(74) *Attorney, Agent, or Firm* — Klarquist Sparkman, LLP

(57) ABSTRACT

Provided are methods and compositions for preparing a library of target nucleic acid sequences that are useful for assessing gene mutations for oncology biomarker profiling of samples. In particular, a target-specific primer panel is provided that allows for selective amplification of oncology biomarker target sequences in a sample. In one aspect, the invention relates to target-specific primers useful for selective amplification of one or more target sequences associated with oncology biomarkers from two or more sample types. In some aspects, amplified target sequences obtained using the disclosed methods, and compositions can be used in various processes including nucleic acid sequencing and used to detect the presence of genetic variants of one or more targeted sequences associated with oncology.

8 Claims, No Drawings

Specification includes a Sequence Listing.

COMPOSITIONS AND METHODS FOR ONCOLOGY PRECISION ASSAYS

CROSS-REFERENCE TO RELATED APPLICATIONS

This application claims priority to and the benefit under 35 U.S.C. § 119(e) of U.S. Provisional Application No. 62/894,576, filed Aug. 30, 2019, which is incorporated herein by reference in its entirety.

SEQUENCE LISTING

This application hereby incorporates by reference the material of the electronic Sequence Listing filed concurrently herewith. The material in the electronic Sequence Listing is submitted as a text (.txt) file entitled "LT01496_STX.txt created on Aug. 27, 2020 which has a file size of 550 KB, and is herein incorporated by reference in its entirety.

FIELD OF THE INVENTION

The present invention relates to compositions and methods of preparing a library of target nucleic acid sequences and uses therefor.

BACKGROUND OF THE INVENTION

Advances in cancer therapies have started to provide promising results across oncology. Targeted therapies, immune checkpoint inhibitors, cancer vaccines and T-cell therapies have shown sustainable results in responsive populations over conventional chemotherapies. However, effective identification of responsive candidates and/or monitoring response has proven challenging. The need of a better understanding of the tumor microenvironment, tumor evolution and drug response biomarkers is immediate. Higher-throughput, systematic and standardized assay solutions that can efficiently and effectively detect multiple relevant biomarkers in a variety of sample types are desirable.

BRIEF SUMMARY OF THE INVENTION

In one aspect of the invention compositions are provided for a single stream multiplex determination of actionable oncology biomarkers in a sample. In some embodiments the composition consists of a plurality of primer reagents directed to a plurality of target sequences to rapidly and effectively detect low level targets in the sample. Provided compositions target oncology gene sequences wherein the plurality of gene sequences are selected from targets among DNA hotspot mutation genes, copy number variation (CNV) genes, inter-genetic fusion genes, and intra-genetic fusion genes. Provided compositions maximize detection of key biomarkers, e.g., EGFR, ALK, BRAF, ROS1, HER2, MET, NTRK, and RET from a variety of samples (e.g., FFPE tissue, plasma) in a single-day in an integrated and automated workflow.

In some embodiments the plurality of actionable target genes in a sample determines a change in oncology activity in the sample indicative of a potential diagnosis, prognosis, candidate therapeutic regimen, and/or adverse event. In particular embodiments, provided compositions include a plurality of primer reagents selected from Table A. In some embodiments a multiplex assay comprising compositions of the invention is provided. In some embodiments a test kit comprising compositions of the invention is provided.

In another aspect of the invention, methods are provided for determining actionable oncology biomarkers in a biological sample. Such methods comprise performing multiplex amplification of a plurality of target sequences from a biological sample containing target sequences. Amplification comprises contacting at least a portion of the sample comprising multiple target sequences of interest using a plurality of target-specific primers in the presence of a polymerase under amplification conditions to produce a plurality of amplified target sequences. The methods further comprise detecting the presence of each of the plurality of target oncology sequences, wherein detection of one or more actionable oncology biomarkers as compared with a control sample determines a change in oncology activity in the sample indicative of a potential diagnosis, prognosis, candidate therapeutic regimen, and/or adverse event. The methods described herein utilize compositions of the invention provided herein. In some embodiments target genes are selected from the group consisting of DNA hotspot mutation genes, copy number variation (CNV) genes, inter-genetic fusion genes, and intra-genetic fusion genes. In certain embodiments target genes are selected from the genes of Table 1. In particular embodiments the target genes consist of the genes of Table 1.

Still further, uses of provided compositions and kits comprising provided compositions for analysis of sequences of the nucleic acid libraries are additional aspects of the invention. In some embodiments, analysis of the sequences of the resulting libraries enables detection of low frequency alleles, improved detection of gene fusions and novel fusions, and/or detection of genetic mutations in a sample of interest and/or multiple samples of interest is provided. In certain embodiments, manual, partially automated and fully automated implementations of uses of provided compositions and methods are contemplated. In a particular embodiment, use of provide compositions is implemented in a fully integrated library preparation, templating and sequencing system for genetic analysis of samples. In certain embodiments, uses of provided compositions and method of the invention provide benefit for research and clinical applications including first line testing of tissue and/or plasma specimens as well as ongoing monitoring of specimens for recurrence and/or resistance detection of biomarkers.

All publications, patents, and patent applications mentioned in this specification are herein incorporated by reference to the same extent as if each individual publication, patent, or patent application was specifically and individually indicated to be incorporated by reference.

Efficient methods for production of targeted libraries encompassing actionable oncology biomarkers from complex samples is desirable for a variety of nucleic acid analyses. The present invention provides, inter alia, methods of preparing libraries of target nucleic acid sequences, allowing for rapid production of highly multiplexed targeted libraries, including unique tag sequences; and resulting library compositions are useful for a variety of applications, including sequencing applications. Provided compositions are designed for the detection of mutations, copy number variations (CNVs), and gene fusions in tissue and plasma derived samples. Provided compositions comprise targeted primer panels and reagents for use in high throughput sample to results next generation workflows for genetic analysis. In particular embodiments, use is implemented on a completely integrated sample to analysis system. Novel features of the invention are set forth with particularity in the appended claims; and a complete understanding of the features and advantages of the present invention will be obtained by reference to the following detailed description that sets forth illustrative embodiments, in which the principles of the invention are utilized.

DESCRIPTION OF THE INVENTION

Section headings used herein are for organizational purposes only and are not to be construed as limiting the described subject matter in any way. All literature and similar materials cited in this application, including but not limited to, patents, patent applications, articles, books, treatises, and interne web pages are expressly incorporated by reference in their entirety for any purpose. When definitions of terms in incorporated references appear to differ from the definitions provided in the present teachings, the definition provided in the present teachings shall control. It will be appreciated that there is an implied "about" prior to the temperatures, concentrations, times, etc discussed in the present teachings, such that slight and insubstantial deviations are within the scope of the present teachings herein. In this application, the use of the singular includes the plural unless specifically stated otherwise. It is noted that, as used in this specification, singular forms "a," "an," and "the," and any singular use of a word, include plural referents unless expressly and unequivocally limited to one referent. Also, the use of "comprise", "comprises", "comprising", "contain", "contains", "containing", "include", "includes", and "including" are not intended to be limiting. It is to be understood that both the general description is exemplary and explanatory only and not restrictive of the invention.

Unless otherwise defined, scientific and technical terms used in connection with the invention described herein shall have the meanings that are commonly understood by those of ordinary skill in the art. Further, unless otherwise required by context, singular terms shall include pluralities and plural terms shall include the singular. Generally, nomenclatures utilized in connection with, and techniques of, cell and tissue culture, molecular biology, and protein and oligo- or polynucleotide chemistry and hybridization used herein are those well-known and commonly used in the art. The practice of the present subject matter may employ, unless otherwise indicated, conventional techniques and descriptions of organic chemistry, molecular biology (including recombinant techniques), cell biology, and biochemistry, which are within the skill of the art. Such conventional techniques include, but are not limited to, preparation of synthetic polynucleotides, polymerization techniques, chemical and physical analysis of polymer particles, preparation of nucleic acid libraries, nucleic acid sequencing and analysis, and the like. Specific illustrations of suitable techniques can be used by reference to the examples provided herein. Other equivalent conventional procedures can also be used. Such conventional techniques and descriptions can be found in standard laboratory manuals such as *Genome Analysis: A Laboratory Manual Series* (Vols. I-IV), *PCR Primer: A Laboratory Manual, and Molecular Cloning: A Laboratory Manual* (all from Cold Spring Harbor Laboratory Press), Hermanson, Bioconjugate Techniques, Second Edition (Academic Press, 2008); Merkus, Particle Size Measurements (Springer, 2009); Rubinstein and Colby, Polymer Physics (Oxford University Press, 2003); and the like. As utilized in accordance with embodiments provided herein, the following terms, unless otherwise indicated, shall be understood to have the following meanings:

As used herein, "amplify", "amplifying" or "amplification reaction" and their derivatives, refer generally to an action or process whereby at least a portion of a nucleic acid molecule (referred to as a template nucleic acid molecule) is replicated or copied into at least one additional nucleic acid molecule. The additional nucleic acid molecule optionally includes sequence that is substantially identical or substantially complementary to at least some portion of the template nucleic acid molecule. A template target nucleic acid molecule may be single-stranded or double-stranded. The additional resulting replicated nucleic acid molecule may independently be single-stranded or double-stranded. In some embodiments, amplification includes a template-dependent in vitro enzyme-catalyzed reaction for the production of at least one copy of at least some portion of a target nucleic acid molecule or the production of at least one copy of a target nucleic acid sequence that is complementary to at least some portion of a target nucleic acid molecule. Amplification optionally includes linear or exponential replication of a nucleic acid molecule. In some embodiments, such amplification is performed using isothermal conditions; in other embodiments, such amplification can include thermocycling. In some embodiments, the amplification is a multiplex amplification that includes simultaneous amplification of a plurality of target sequences in a single amplification reaction. At least some target sequences can be situated on the same nucleic acid molecule or on different target nucleic acid molecules included in a single amplification reaction. In some embodiments, "amplification" includes amplification of at least some portion of DNA- and/or RNA-based nucleic acids, whether alone, or in combination. An amplification reaction can include single or double-stranded nucleic acid substrates and can further include any amplification processes known to one of ordinary skill in the art. In some embodiments, an amplification reaction includes polymerase chain reaction (PCR). In some embodiments, an amplification reaction includes isothermal amplification.

As used herein, "amplification conditions" and derivatives (e.g., conditions for amplification, etc.) generally refers to conditions suitable for amplifying one or more nucleic acid sequences. Amplification can be linear or exponential. In some embodiments, amplification conditions include isothermal conditions or alternatively include thermocycling conditions, or a combination of isothermal and themocycling conditions. In some embodiments, conditions suitable for amplifying one or more target nucleic acid sequences includes polymerase chain reaction (PCR) conditions. Typically, amplification conditions refer to a reaction mixture that is sufficient to amplify nucleic acids such as one or more target sequences, or to amplify an amplified target sequence ligated to one or more adaptors, e.g., an adaptor-ligated amplified target sequence. Generally, amplification conditions include a catalyst for amplification or for nucleic acid synthesis, for example a polymerase; a primer that possesses some degree of complementarity to the nucleic acid to be amplified; and nucleotides, such as deoxyribonucleoside triphosphates (dNTPs) to promote extension of a primer once hybridized to a nucleic acid. Amplification conditions can require hybridization or annealing of a primer to a nucleic acid, extension of the primer and a denaturing step in which the extended primer is separated from the nucleic acid sequence undergoing amplification. Typically, though not necessarily, amplification conditions can include thermocycling. In some embodiments, amplification conditions include a plurality of cycles wherein steps of annealing, extending and separating are repeated. Typically, amplification conditions include cations such as $Mg^{++}$ or $Mn^{++}$ (e.g., $MgCl_2$, etc.) and can also optionally include various modifiers of ionic strength.

As used herein, "target sequence" "target nucleic acid sequence" or "target sequence of interest" and derivatives, refers generally to any single or double-stranded nucleic acid sequence that can be amplified or synthesized according to the disclosure, including any nucleic acid sequence suspected or expected to be present in a sample. In some embodiments, the target sequence is present in double-stranded form and includes at least a portion of the particular nucleotide sequence to be amplified or synthesized, or its complement, prior to the addition of target-specific primers or appended adaptors. Target sequences can include the nucleic acids to which primers useful in the amplification or synthesis reaction can hybridize prior to extension by a polymerase. In some embodiments, the term refers to a nucleic acid sequence whose sequence identity, ordering or location of nucleotides is determined by one or more of the methods of the disclosure.

The term "portion" and its variants, as used herein, when used in reference to a given nucleic acid molecule, for example a primer or a template nucleic acid molecule, comprises any number of contiguous nucleotides within the length of the nucleic acid molecule, including the partial or entire length of the nucleic acid molecule.

As used herein, "contacting" and its derivatives, when used in reference to two or more components, refers generally to any process whereby the approach, proximity, mixture or commingling of the referenced components is promoted or achieved without necessarily requiring physical contact of such components, and includes mixing of solutions containing any one or more of the referenced components with each other. The referenced components may be contacted in any particular order or combination and the particular order of recitation of components is not limiting. For example, "contacting A with B and C" encompasses embodiments where A is first contacted with B then C, as well as embodiments where C is contacted with A then B, as well as embodiments where a mixture of A and C is contacted with B, and the like. Furthermore, such contacting does not necessarily require that the end result of the contacting process be a mixture including all of the referenced components, as long as at some point during the contacting process all of the referenced components are simultaneously present or simultaneously included in the same mixture or solution. For example, "contacting A with B and C" can include embodiments wherein C is first contacted with A to form a first mixture, which first mixture is then contacted with B to form a second mixture, following which C is removed from the second mixture; optionally A can then also be removed, leaving only B. Where one or more of the referenced components to be contacted includes a plurality (e.g., "contacting a target sequence with a plurality of target-specific primers and a polymerase"), then each member of the plurality can be viewed as an individual component of the contacting process, such that the contacting can include contacting of any one or more members of the plurality with any other member of the plurality and/or with any other referenced component (e.g., some but not all of the plurality of target specific primers can be contacted with a target sequence, then a polymerase, and then with other members of the plurality of target-specific primers) in any order or combination.

As used herein, the term "primer" and its derivatives refer generally to any polynucleotide that can hybridize to a target sequence of interest. In some embodiments, the primer can also serve to prime nucleic acid synthesis. Typically, a primer functions as a substrate onto which nucleotides can be polymerized by a polymerase; in some embodiments, however, a primer can become incorporated into a synthesized nucleic acid strand and provide a site to which another primer can hybridize to prime synthesis of a new strand that is complementary to the synthesized nucleic acid molecule. A primer may be comprised of any combination of nucleotides or analogs thereof, which may be optionally linked to form a linear polymer of any suitable length. In some embodiments, a primer is a single-stranded oligonucleotide or polynucleotide. (For purposes of this disclosure, the terms 'polynucleotide" and "oligonucleotide" are used interchangeably herein and do not necessarily indicate any difference in length between the two). In some embodiments, a primer is double-stranded. If double stranded, a primer is first treated to separate its strands before being used to prepare extension products. Preferably, the primer is an oligodeoxyribonucleotide. A primer must be sufficiently long to prime the synthesis of extension products. Lengths of the primers will depend on many factors, including temperature, source of primer and the use of the method. In some embodiments, a primer acts as a point of initiation for amplification or synthesis when exposed to amplification or synthesis conditions; such amplification or synthesis can occur in a template-dependent fashion and optionally results in formation of a primer extension product that is complementary to at least a portion of the target sequence. Exemplary amplification or synthesis conditions can include contacting the primer with a polynucleotide template (e.g., a template including a target sequence), nucleotides and an inducing agent such as a polymerase at a suitable temperature and pH to induce polymerization of nucleotides onto an end of the target-specific primer. If double-stranded, the primer can optionally be treated to separate its strands before being used to prepare primer extension products. In some embodiments, the primer is an oligodeoxyribonucleotide or an oligoribonucleotide. In some embodiments, the primer can include one or more nucleotide analogs. The exact length and/or composition, including sequence, of the target-specific primer can influence many properties, including melting temperature (Tm), GC content, formation of secondary structures, repeat nucleotide motifs, length of predicted primer extension products, extent of coverage across a nucleic acid molecule of interest, number of primers present in a single amplification or synthesis reaction, presence of nucleotide analogs or modified nucleotides within the primers, and the like. In some embodiments, a primer can be paired with a compatible primer within an amplification or synthesis reaction to form a primer pair consisting or a forward primer and a reverse primer. In some embodiments, the forward primer of the primer pair includes a sequence that is substantially complementary to at least a portion of a strand of a nucleic acid molecule, and the reverse primer of the primer of the primer pair includes a sequence that is substantially identical to at least of portion of the strand. In some embodiments, the forward primer and the reverse primer are capable of hybridizing to opposite strands of a nucleic acid duplex. Optionally, the forward primer primes synthesis of a first nucleic acid strand, and the reverse primer primes synthesis of a second nucleic acid strand, wherein the first and second strands are substantially complementary to each other, or can hybridize to form a double-stranded nucleic acid molecule. In some embodiments, one end of an amplification or synthesis product is defined by the forward primer and the other end of the amplification or synthesis product is defined by the reverse primer. In some embodiments, where the amplification or synthesis of lengthy primer extension products is required, such as amplifying an exon, coding region, or gene, several primer pairs can be created than span the desired length to enable sufficient amplification of the region. In some embodiments, a primer can include one or more cleavable groups. In some embodiments, primer lengths are in the range of about 10 to about 60 nucleotides, about 12 to about 50 nucleotides and about 15 to about 40 nucleotides in length. Typically, a primer is capable of hybridizing to a corresponding target sequence and undergoing primer extension when exposed to amplification conditions in the presence of dNTPS and a polymerase. In some instances, the particular nucleotide sequence or a portion of the primer is known at the outset of the amplification reaction or can be determined by one or more of the methods disclosed herein. In some embodiments, the primer includes one or more cleavable groups at one or more locations within the primer.

As used herein, "target-specific primer" and its derivatives, refers generally to a single stranded or double-stranded polynucleotide, typically an oligonucleotide, that includes at least one sequence that is at least 50% complementary, typically at least 75% complementary or at least 85% complementary, more typically at least 90% complementary, more typically at least 95% complementary, more typically at least 98% or at least 99% complementary, or identical, to at least a portion of a nucleic acid molecule that includes a target sequence. In such instances, the target-specific primer and target sequence are described as "corresponding" to each other. In some embodiments, the target-specific primer is capable of hybridizing to at least a portion of its corresponding target sequence (or to a complement of the target sequence); such hybridization can optionally be performed under standard hybridization conditions or under stringent hybridization conditions. In some embodiments, the target-specific primer is not capable of hybridizing to the target sequence, or to its complement, but is capable of hybridizing to a portion of a nucleic acid strand including the target sequence, or to its complement. In some embodiments, the target-specific primer includes at least one sequence that is at least 75% complementary, typically at least 85% complementary, more typically at least 90% complementary, more typically at least 95% complementary, more typically at least 98% complementary, or more typically at least 99% complementary, to at least a portion of the target sequence itself; in other embodiments, the target-specific primer includes at least one sequence that is at least 75% complementary, typically at least 85% complementary, more typically at least 90% complementary, more typically at least 95% complementary, more typically at least 98% complementary, or more typically at least 99% complementary, to at least a portion of the nucleic acid molecule other than the target sequence. In some embodiments, the target-specific primer is substantially non-complementary to other target sequences present in the sample; optionally, the target-specific primer is substantially non-complementary to other nucleic acid molecules present in the sample. In some embodiments, nucleic acid molecules present in the sample that do not include or correspond to a target sequence (or to a complement of the target sequence) are referred to as "non-specific" sequences or "non-specific nucleic acids". In some embodiments, the target-specific primer is designed to include a nucleotide sequence that is substantially complementary to at least a portion of its corresponding target sequence. In some embodiments, a target-specific primer is at least 95% complementary, or at least 99% complementary, or identical, across its entire length to at least a portion of a nucleic acid molecule that includes its corresponding target sequence. In some embodiments, a target-specific primer can be at least 90%, at least 95% complementary, at least 98% complementary or at least 99% complementary, or identical, across its entire length to at least a portion of its corresponding target sequence. In some embodiments, a forward target-specific primer and a reverse target-specific primer define a target-specific primer pair that can be used to amplify the target sequence via template-dependent primer extension. Typically, each primer of a target-specific primer pair includes at least one sequence that is substantially complementary to at least a portion of a nucleic acid molecule including a corresponding target sequence but that is less than 50% complementary to at least one other target sequence in the sample. In some embodiments, amplification can be performed using multiple target-specific primer pairs in a single amplification reaction, wherein each primer pair includes a forward target-specific primer and a reverse target-specific primer, each including at least one sequence that substantially complementary or substantially identical to a corresponding target sequence in the sample, and each primer pair having a different corresponding target sequence. In some embodiments, the target-specific primer can be substantially non-complementary at its 3' end or its 5' end to any other target-specific primer present in an amplification reaction. In some embodiments, the target-specific primer can include minimal cross hybridization to other target-specific primers in the amplification reaction. In some embodiments, target-specific primers include minimal cross-hybridization to non-specific sequences in the amplification reaction mixture. In some embodiments, the target-specific primers include minimal self-complementarity. In some embodiments, the target-specific primers can include one or more cleavable groups located at the 3' end. In some embodiments, the target-specific primers can include one or more cleavable groups located near or about a central nucleotide of the target-specific primer. In some embodiments, one of more targets-specific primers includes only non-cleavable nucleotides at the 5' end of the target-specific primer. In some embodiments, a target specific primer includes minimal nucleotide sequence overlap at the 3' end or the 5' end of the primer as compared to one or more different target-specific primers, optionally in the same amplification reaction. In some embodiments 1, 2, 3, 4, 5, 6, 7, 8, 9, 10 or more, target-specific primers in a single reaction mixture include one or more of the above embodiments. In some embodiments, substantially all of the plurality of target-specific primers in a single reaction mixture includes one or more of the above embodiments.

As used herein, the term "adaptor" denotes a nucleic acid molecule that can be used for manipulation of a polynucleotide of interest. In some embodiments, adaptors are used for amplification of one or more target nucleic acids. In some embodiments, the adaptors are used in reactions for sequencing. In some embodiments, an adaptor has one or more ends that lack a 5' phosphate residue. In some embodiments, an adaptor comprises, consists of, or consist essentially of at least one priming site. Such priming site containing adaptors can be referred to as "primer" adaptors. In some embodiments, the adaptor priming site can be useful in PCR processes. In some embodiments an adaptor includes a nucleic acid sequence that is substantially complementary to the 3' end or the 5' end of at least one target sequences within the sample, referred to herein as a gene specific target sequence, a target specific sequence, or target specific primer. In some embodiments, the adaptor includes nucleic acid sequence that is substantially non-complementary to the 3' end or the 5' end of any target sequence present in the sample. In some embodiments, the adaptor includes single stranded or double-stranded linear oligonucleotide that is not substantially complementary to an target nucleic acid sequence. In some embodiments, the adaptor includes nucleic acid sequence that is substantially non-complementary to at least one, and preferably some or all of the nucleic acid molecules of the sample. In some embodiments, suitable adaptor lengths are in the range of about 10-75 nucleotides, about 12-50 nucleotides and about 15-40 nucleotides in length. Generally, an adaptor can include any combination of nucleotides and/or nucleic acids. In some aspects, adaptors include one or more cleavable groups at one or more locations. In some embodiments, the adaptor includes sequence that is substantially identical, or substantially complementary, to at least a portion of a primer, for example a universal primer. In some embodiments, adaptors include a tag sequence to assist with cataloguing, identification or sequencing. In some embodiments, an adaptor acts as a substrate for amplification of a target sequence, particularly in the presence of a polymerase and dNTPs under suitable temperature and pH.

As used herein, "polymerase" and its derivatives, generally refers to any enzyme that can catalyze the polymerization of nucleotides (including analogs thereof) into a nucleic acid strand. Typically but not necessarily, such nucleotide polymerization can occur in a template-dependent fashion. Such polymerases can include without limitation naturally occurring polymerases and any subunits and truncations thereof, mutant polymerases, variant polymerases, recombinant, fusion or otherwise engineered polymerases, chemically modified polymerases, synthetic molecules or assemblies, and any analogs, derivatives or fragments thereof that retain the ability to catalyze such polymerization. Optionally, the polymerase can be a mutant polymerase comprising one or more mutations involving the replacement of one or more amino acids with other amino acids, the insertion or deletion of one or more amino acids from the polymerase, or the linkage of parts of two or more polymerases. Typically, the polymerase comprises one or more active sites at which nucleotide binding and/or catalysis of nucleotide polymerization can occur. Some exemplary polymerases include without limitation DNA polymerases and RNA polymerases. The term "polymerase" and its variants, as used herein, also refers to fusion proteins comprising at least two portions linked to each other, where the first portion comprises a peptide that can catalyze the polymerization of nucleotides into a nucleic acid strand and is linked to a second portion that comprises a second polypeptide. In some embodiments, the second polypeptide can include a reporter enzyme or a processivity-enhancing domain. Optionally, the polymerase can possess 5' exonuclease activity or terminal transferase activity. In some embodiments, the polymerase can be optionally reactivated, for example through the use of heat, chemicals or re-addition of new amounts of polymerase into a reaction mixture. In some embodiments, the polymerase can include a hot-start polymerase and/or an aptamer based polymerase that optionally can be reactivated.

The terms "identity" and "identical" and their variants, as used herein, when used in reference to two or more nucleic acid sequences, refer to similarity in sequence of the two or more sequences (e.g., nucleotide or polypeptide sequences). In the context of two or more homologous sequences, the percent identity or homology of the sequences or subsequences thereof indicates the percentage of all monomeric units (e.g., nucleotides or amino acids) that are the same (i.e., about 70% identity, preferably 75%, 80%, 85%, 90%, 95%, 98% or 99% identity). The percent identity can be over a specified region, when compared and aligned for maximum correspondence over a comparison window, or designated region as measured using a BLAST or BLAST 2.0 sequence comparison algorithms with default parameters described below, or by manual alignment and visual inspection. Sequences are said to be "substantially identical" when there is at least 85% identity at the amino acid level or at the nucleotide level. Preferably, the identity exists over a region that is at least about 25, 50, or 100 residues in length, or across the entire length of at least one compared sequence. A typical algorithm for determining percent sequence identity and sequence similarity are the BLAST and BLAST 2.0 algorithms, which are described in Altschul et al, Nuc. Acids Res. 25:3389-3402 (1977). Other methods include the algorithms of Smith & Waterman, Adv. Appl. Math. 2:482 (1981), and Needleman & Wunsch, J. Mol. Biol. 48:443 (1970), etc. Another indication that two nucleic acid sequences are substantially identical is that the two molecules or their complements hybridize to each other under stringent hybridization conditions.

The terms "complementary" and "complement" and their variants, as used herein, refer to any two or more nucleic acid sequences (e.g., portions or entireties of template nucleic acid molecules, target sequences and/or primers) that can undergo cumulative base pairing at two or more individual corresponding positions in antiparallel orientation, as in a hybridized duplex. Such base pairing can proceed according to any set of established rules, for example according to Watson-Crick base pairing rules or according to some other base pairing paradigm. Optionally there can be "complete" or "total" complementarity between a first and second nucleic acid sequence where each nucleotide in the first nucleic acid sequence can undergo a stabilizing base pairing interaction with a nucleotide in the corresponding antiparallel position on the second nucleic acid sequence. "Partial" complementarity describes nucleic acid sequences in which at least 20%, but less than 100%, of the residues of one nucleic acid sequence are complementary to residues in the other nucleic acid sequence. In some embodiments, at least 50%, but less than 100%, of the residues of one nucleic acid sequence are complementary to residues in the other nucleic acid sequence. In some embodiments, at least 70%, 80%, 90%, 95% or 98%, but less than 100%, of the residues of one nucleic acid sequence are complementary to residues in the other nucleic acid sequence. Sequences are said to be "substantially complementary" when at least 85% of the residues of one nucleic acid sequence are complementary to residues in the other nucleic acid sequence. In some embodiments, two complementary or substantially complementary sequences are capable of hybridizing to each other under standard or stringent hybridization conditions. "Non-complementary" describes nucleic acid sequences in which less than 20% of the residues of one nucleic acid sequence are complementary to residues in the other nucleic acid sequence. Sequences are said to be "substantially non-complementary" when less than 15% of the residues of one nucleic acid sequence are complementary to residues in the other nucleic acid sequence. In some embodiments, two non-complementary or substantially non-complementary sequences cannot hybridize to each other under standard or stringent hybridization conditions. A "mismatch" is present at any position in the two opposed nucleotides are not complementary. Complementary nucleotides include nucleotides that are efficiently incorporated by DNA polymerases opposite each other during DNA replication under physiological conditions. In a typical embodiment, complementary nucleotides can form base pairs with each other, such as the A-T/U and G-C base pairs formed through specific Watson-Crick type hydrogen bonding, or base pairs formed through some other type of base pairing paradigm, between the nucleobases of nucleotides and/or polynucleotides in positions antiparallel to each other. The complementarity of other artificial base pairs can be based on other types of hydrogen bonding and/or hydrophobicity of bases and/or shape complementarity between bases.

As used herein, "amplified target sequences" and its derivatives, refers generally to a nucleic acid sequence produced by the amplification of/amplifying the target sequences using target-specific primers and the methods provided herein. The amplified target sequences may be either of the same sense (the positive strand produced in the second round and subsequent even-numbered rounds of amplification) or antisense (i.e., the negative strand produced during the first and subsequent odd-numbered rounds of amplification) with respect to the target sequences. For the purposes of this disclosure, amplified target sequences are typically less than 50% complementary to any portion of another amplified target sequence in the reaction.

As used herein, terms "ligating", "ligation" and derivatives refer generally to the act or process for covalently linking two or more molecules together, for example, covalently linking two or more nucleic acid molecules to each other. In some embodiments, ligation includes joining nicks between adjacent nucleotides of nucleic acids. In some embodiments, ligation includes forming a covalent bond between an end of a first and an end of a second nucleic acid molecule. In some embodiments, for example embodiments wherein the nucleic acid molecules to be ligated include conventional nucleotide residues, the ligation can include forming a covalent bond between a 5' phosphate group of one nucleic acid and a 3' hydroxyl group of a second nucleic acid thereby forming a ligated nucleic acid molecule. In some embodiments, any means for joining nicks or bonding a 5'phosphate to a 3' hydroxyl between adjacent nucleotides can be employed. In an exemplary embodiment, an enzyme such as a ligase can be used.

As used herein, "ligase" and its derivatives, refers generally to any agent capable of catalyzing the ligation of two substrate molecules. In some embodiments, the ligase includes an enzyme capable of catalyzing the joining of nicks between adjacent nucleotides of a nucleic acid. In some embodiments, a ligase includes an enzyme capable of catalyzing the formation of a covalent bond between a 5' phosphate of one nucleic acid molecule to a 3' hydroxyl of another nucleic acid molecule thereby forming a ligated nucleic acid molecule. Suitable ligases may include, but not limited to, T4 DNA ligase; T7 DNA ligase; Taq DNA ligase, and E. coli DNA ligase.

As defined herein, a "cleavable group" generally refers to any moiety that once incorporated into a nucleic acid can be cleaved under appropriate conditions. For example, a cleavable group can be incorporated into a target-specific primer, an amplified sequence, an adaptor or a nucleic acid molecule of the sample. In an exemplary embodiment, a target-specific primer can include a cleavable group that becomes incorporated into the amplified product and is subsequently cleaved after amplification, thereby removing a portion, or all, of the target-specific primer from the amplified product. The cleavable group can be cleaved or otherwise removed from a target-specific primer, an amplified sequence, an adaptor or a nucleic acid molecule of the sample by any acceptable means. For example, a cleavable group can be removed from a target-specific primer, an amplified sequence, an adaptor or a nucleic acid molecule of the sample by enzymatic, thermal, photo-oxidative or chemical treatment. In one aspect, a cleavable group can include a nucleobase that is not naturally occurring. For example, an oligodeoxyribonucleotide can include one or more RNA nucleobases, such as uracil that can be removed by a uracil glycosylase. In some embodiments, a cleavable group can include one or more modified nucleobases (such as 7-methylguanine, 8-oxo-guanine, xanthine, hypoxanthine, 5,6-dihydrouracil or 5-methylcytosine) or one or more modified nucleosides (i.e., 7-methylguanosine, 8-oxo-deoxyguanosine, xanthosine, inosine, dihydrouridine or 5-methylcytidine). The modified nucleobases or nucleotides can be removed from the nucleic acid by enzymatic, chemical or thermal means. In one embodiment, a cleavable group can include a moiety that can be removed from a primer after amplification (or synthesis) upon exposure to ultraviolet light (i.e., bromodeoxyuridine). In another embodiment, a cleavable group can include methylated cytosine. Typically, methylated cytosine can be cleaved from a primer for example, after induction of amplification (or synthesis), upon sodium bisulfite treatment. In some embodiments, a cleavable moiety can include a restriction site. For example, a primer or target sequence can include a nucleic acid sequence that is specific to one or more restriction enzymes, and following amplification (or synthesis), the primer or target sequence can be treated with the one or more restriction enzymes such that the cleavable group is removed. Typically, one or more cleavable groups can be included at one or more locations with a target-specific primer, an amplified sequence, an adaptor or a nucleic acid molecule of the sample.

As used herein, "digestion", "digestion step" and its derivatives, generally refers to any process by which a cleavable group is cleaved or otherwise removed from a target-specific primer, an amplified sequence, an adaptor or a nucleic acid molecule of the sample. In some embodiments, the digestion step involves a chemical, thermal, photo-oxidative or digestive process.

As used herein, the term "hybridization" is consistent with its use in the art, and generally refers to the process whereby two nucleic acid molecules undergo base pairing interactions. Two nucleic acid molecule molecules are said to be hybridized when any portion of one nucleic acid molecule is base paired with any portion of the other nucleic acid molecule; it is not necessarily required that the two nucleic acid molecules be hybridized across their entire respective lengths and in some embodiments, at least one of the nucleic acid molecules can include portions that are not hybridized to the other nucleic acid molecule. The phrase "hybridizing under stringent conditions" and its variants refers generally to conditions under which hybridization of a target-specific primer to a target sequence occurs in the presence of high hybridization temperature and low ionic strength. As used herein, the phrase "standard hybridization conditions" and its variants refers generally to conditions under which hybridization of a primer to an oligonucleotide (i.e., a target sequence), occurs in the presence of low hybridization temperature and high ionic strength. In one exemplary embodiment, standard hybridization conditions include an aqueous environment containing about 100 mm magnesium sulfate, about 500 mM Tris-sulfate at pH 8.9, and about 200 mM ammonium sulfate at about 50-55° C., or equivalents thereof.

As used herein, the term "end" and its variants, when used in reference to a nucleic acid molecule, for example a target sequence or amplified target sequence, can include the terminal 30 nucleotides, the terminal 20 and even more typically the terminal 15 nucleotides of the nucleic acid molecule. A linear nucleic acid molecule comprised of linked series of contiguous nucleotides typically includes at least two ends. In some embodiments, one end of the nucleic acid molecule can include a 3' hydroxyl group or its equivalent, and can be referred to as the "3' end" and its derivatives. Optionally, the 3' end includes a 3' hydroxyl group that is not linked to a 5' phosphate group of a mononucleotide pentose ring. Typically, the 3' end includes one or more 5' linked nucleotides located adjacent to the nucleotide including the unlinked 3' hydroxyl group, typically the 30 nucleotides located adjacent to the 3' hydroxyl, typically the terminal 20 and even more typically the terminal 15 nucleotides. Generally, the one or more linked nucleotides can be represented as a percentage of the nucleotides present in the oligonucleotide or can be provided as a number of linked nucleotides adjacent to the unlinked 3' hydroxyl. For example, the 3' end can include less than 50% of the nucleotide length of the oligonucleotide. In some embodiments, the 3' end does not include any unlinked 3' hydroxyl group but can include any moiety capable of serving as a site for attachment of nucleotides via primer extension and/or nucleotide polymerization. In some embodiments, the term "3' end" for example when referring to a target-specific primer, can include the terminal 10 nucleotides, the terminal 5 nucleotides, the terminal 4, 3, 2 or fewer nucleotides at the 3'end. In some embodiments, the term "3' end" when referring to a target-specific primer can include nucleotides located at nucleotide positions 10 or fewer from the 3' terminus. As used herein, "5' end", and its derivatives, generally refers to an end of a nucleic acid molecule, for example a target sequence or amplified target sequence, which includes a free 5' phosphate group or its equivalent. In some embodiments, the 5' end includes a 5' phosphate group that is not linked to a 3' hydroxyl of a neighboring mononucleotide pentose ring. Typically, the 5' end includes to one or more linked nucleotides located adjacent to the 5' phosphate, typically the 30 nucleotides located adjacent to the nucleotide including the 5' phosphate group, typically the terminal 20 and even more typically the terminal 15 nucleotides. Generally, the one or more linked nucleotides can be represented as a percentage of the nucleotides present in the oligonucleotide or can be provided as a number of linked nucleotides adjacent to the 5' phosphate. For example, the 5' end can be less than 50% of the nucleotide length of an oligonucleotide. In another exemplary embodiment, the 5' end can include about 15 nucleotides adjacent to the nucleotide including the terminal 5' phosphate. In some embodiments, the 5' end does not include any unlinked 5' phosphate group but can include any moiety capable of serving as a site of attachment to a 3' hydroxyl group, or to the 3'end of another nucleic acid molecule. In some embodiments, the term "5' end" for example when referring to a target-specific primer, can include the terminal 10 nucleotides, the terminal 5 nucleotides, the terminal 4, 3, 2 or fewer nucleotides at the 5'end. In some embodiments, the term "5' end" when referring to a target-specific primer can include nucleotides located at positions 10 or fewer from the 5' terminus. In some embodiments, the 5' end of a target-specific primer can include only non-cleavable nucleotides, for example nucleotides that do not contain one or more cleavable groups as disclosed herein, or a cleavable nucleotide as would be readily determined by one of ordinary skill in the art. A "first end" and a "second end" of a polynucleotide refer to the 5' end or the 3'end of the polynucleotide. Either the first end or second end of a polynucleotide can be the 5' end or the 3' end of the polynucleotide; the terms "first" and "second" are not meant to denote that the end is specifically the 5' end or the 3' end.

As used herein "tag," "barcode," "unique tag" or "tag sequence" and its derivatives, refers generally to a unique short (6-14 nucleotide) nucleic acid sequence within an adaptor or primer that can act as a 'key' to distinguish or separate a plurality of amplified target sequences in a sample. For the purposes of this disclosure, a barcode or unique tag sequence is incorporated into the nucleotide sequence of an adaptor or primer. As used herein, "barcode sequence" denotes a nucleic acid fixed sequence that is sufficient to allow for the identification of a sample or source of nucleic acid sequences of interest. A barcode sequence can be, but need not be, a small section of the original nucleic acid sequence on which the identification is to be based. In some embodiments a barcode is 5-20 nucleic acids long. In some embodiments, the barcode is comprised of analog nucleotides, such as L-DNA, LNA, PNA, etc. As used herein, "unique tag sequence" denotes a nucleic acid sequence having at least one random sequence and at least one fixed sequence. A unique tag sequence, alone or in conjunction with a second unique tag sequence, is sufficient to allow for the identification of a single target nucleic acid molecule in a sample. A unique tag sequence can, but need not, comprise a small section of the original target nucleic acid sequence. In some embodiments a unique tag sequence is 2-50 nucleotides or base-pairs, or 2-25 nucleotides or base-pairs, or 2-10 nucleotides or base-pairs in length. A unique tag sequence can comprise at least one random sequence interspersed with a fixed sequence.

As used herein, "comparable maximal minimum melting temperatures" and its derivatives, refers generally to the melting temperature (Tm) of each nucleic acid fragment for a single adaptor or target-specific primer after digestion of a cleavable groups. The hybridization temperature of each nucleic acid fragment generated by an adaptor or target-specific primer is compared to determine the maximal minimum temperature required preventing hybridization of a nucleic acid sequence from the target-specific primer or adaptor or fragment or portion thereof to a respective target sequence. Once the maximal hybridization temperature is known, it is possible to manipulate the adaptor or target-specific primer, for example by moving the location of one or more cleavable group(s) along the length of the primer, to achieve a comparable maximal minimum melting temperature with respect to each nucleic acid fragment to thereby optimize digestion and repair steps of library preparation.

As used herein, "addition only" and its derivatives, refers generally to a series of steps in which reagents and components are added to a first or single reaction mixture. Typically, the series of steps excludes the removal of the reaction mixture from a first vessel to a second vessel in order to complete the series of steps. Generally, an addition only process excludes the manipulation of the reaction mixture outside the vessel containing the reaction mixture. Typically, an addition-only process is amenable to automation and high-throughput.

As used herein, "polymerizing conditions" and its derivatives, refers generally to conditions suitable for nucleotide polymerization. In typical embodiments, such nucleotide polymerization is catalyzed by a polymerase. In some embodiments, polymerizing conditions include conditions for primer extension, optionally in a template-dependent manner, resulting in the generation of a synthesized nucleic acid sequence. In some embodiments, the polymerizing conditions include polymerase chain reaction (PCR). Typically, the polymerizing conditions include use of a reaction mixture that is sufficient to synthesize nucleic acids and includes a polymerase and nucleotides. The polymerizing conditions can include conditions for annealing of a target-specific primer to a target sequence and extension of the primer in a template dependent manner in the presence of a polymerase. In some embodiments, polymerizing conditions can be practiced using thermocycling. Additionally, polymerizing conditions can include a plurality of cycles where the steps of annealing, extending, and separating the two nucleic strands are repeated. Typically, the polymerizing conditions include a cation such as $MgCl_2$. Generally, polymerization of one or more nucleotides to form a nucleic acid strand includes that the nucleotides be linked to each other via phosphodiester bonds, however, alternative linkages may be possible in the context of particular nucleotide analogs.

As used herein, the term "nucleic acid" refers to natural nucleic acids, artificial nucleic acids, analogs thereof, or combinations thereof, including polynucleotides and oligonucleotides. As used herein, the terms "polynucleotide" and "oligonucleotide" are used interchangeably and mean single-stranded and double-stranded polymers of nucleotides including, but not limited to, 2'-deoxyribonucleotides (nucleic acid) and ribonucleotides (RNA) linked by internucleotide phosphodiester bond linkages, e.g. 3'-5' and 2'-5', inverted linkages, e.g. 3'-3' and 5'-5', branched structures, or analog nucleic acids. Polynucleotides have associated counter ions, such as $H^+$, $NH_4^+$, trialkylammonium, $Mg^{2+}$, $Na^+$ and the like. An oligonucleotide can be composed entirely of deoxyribonucleotides, entirely of ribonucleotides, or chimeric mixtures thereof. Oligonucleotides can be comprised of nucleobase and sugar analogs. Polynucleotides typically range in size from a few monomeric units, e.g. 5-40, when they are more commonly frequently referred to in the art as oligonucleotides, to several thousands of monomeric nucleotide units, when they are more commonly referred to in the art as polynucleotides; for purposes of this disclosure, however, both oligonucleotides and polynucleotides may be of any suitable length. Unless denoted otherwise, whenever a oligonucleotide sequence is represented, it will be understood that the nucleotides are in 5' to 3' order from left to right and that "A" denotes deoxyadenosine, "C" denotes deoxycytidine, "G" denotes deoxyguanosine, "T" denotes thymidine, and "U' denotes deoxyuridine. As discussed herein and known in the art, oligonucleotides and polynucleotides are said to have "5' ends" and "3' ends" because mononucleotides are typically reacted to form oligonucleotides via attachment of the 5' phosphate or equivalent group of one nucleotide to the 3' hydroxyl or equivalent group of its neighboring nucleotide, optionally via a phosphodiester or other suitable linkage.

As used herein, the term "polymerase chain reaction" ("PCR") refers to the method of K. B. Mullis U.S. Pat. Nos. 4,683,195 and 4,683,202, hereby incorporated by reference, which describe a method for increasing the concentration of a segment of a polynucleotide of interest in a mixture of genomic DNA without cloning or purification. This process for amplifying the polynucleotide of interest consists of introducing a large excess of two oligonucleotide primers to the DNA mixture containing the desired polynucleotide of interest, followed by a precise sequence of thermal cycling in the presence of a DNA polymerase. The two primers are complementary to their respective strands of the double stranded polynucleotide of interest. To effect amplification, the mixture is denatured and the primers then annealed to their complementary sequences within the polynucleotide of interest molecule. Following annealing, the primers are extended with a polymerase to form a new pair of complementary strands. The steps of denaturation, primer annealing and polymerase extension can be repeated many times (i.e., denaturation, annealing and extension constitute one "cycle"; there can be numerous "cycles") to obtain a high concentration of an amplified segment of the desired polynucleotide of interest. The length of the amplified segment of the desired polynucleotide of interest (amplicon) is determined by the relative positions of the primers with respect to each other, and therefore, this length is a controllable parameter. By virtue of repeating the process, the method is referred to as the "polymerase chain reaction" (hereinafter "PCR"). Because the desired amplified segments of the polynucleotide of interest become the predominant nucleic acid sequences (in terms of concentration) in the mixture, they are said to be "PCR amplified". As defined herein, target nucleic acid molecules within a sample including a plurality of target nucleic acid molecules are amplified via PCR. In a modification to the method discussed above, the target nucleic acid molecules can be PCR amplified using a plurality of different primer pairs, in some cases, one or more primer pairs per target nucleic acid molecule of interest, thereby forming a multiplex PCR reaction. Using multiplex PCR, it is possible to simultaneously amplify multiple nucleic acid molecules of interest from a sample to form amplified target sequences. It is also possible to detect the amplified target sequences by several different methodologies (e.g., quantitation with a bioanalyzer or qPCR, hybridization with a labeled probe; incorporation of biotinylated primers followed by avidin-enzyme conjugate detection; incorporation of $^{32}P$-labeled deoxynucleotide triphosphates, such as dCTP or dATP, into the amplified target sequence). Any oligonucleotide sequence can be amplified with the appropriate set of primers, thereby allowing for the amplification of target nucleic acid molecules from genomic DNA, cDNA, formalin-fixed paraffin-embedded DNA, fine-needle biopsies and various other sources. In particular, the amplified target sequences created by the multiplex PCR process as disclosed herein, are themselves efficient substrates for subsequent PCR amplification or various downstream assays or manipulations.

As defined herein "multiplex amplification" refers to selective and non-random amplification of two or more target sequences within a sample using at least one target-specific primer. In some embodiments, multiplex amplification is performed such that some or all of the target sequences are amplified within a single reaction vessel. The "plexy" or "plex" of a given multiplex amplification refers generally to the number of different target-specific sequences that are amplified during that single multiplex amplification. In some embodiments, the plexy can be about 12-plex, 24-plex, 48-plex, 96-plex, 192-plex, 384-plex, 768-plex, 1536-plex, 3072-plex, 6144-plex or higher.

Compositions

We have developed a single stream multiplex next generation sequencing workflow for determination of actionable oncology tumor biomarkers in a sample, in order to determine oncology status in a sample. The oncology precision assay compositions and methods of the invention offer a specific and robust solution for biomarker screening for understanding mechanisms involved with tumor immune response. Thus, provided are compositions for multiplex library preparation and use in conjunction with next generation sequencing technologies and workflow solutions (e.g., Ion Torrent™ NGS workflow), manual or automated, to evaluate low level biomarker targets in a variety of sample types to assess oncology status.

Thus, provided are compositions for a single stream multiplex determination of actionable oncology biomarkers in a sample. In some embodiments, the composition consists of a plurality of sets of primer pair reagents directed to a plurality of target sequences to detect low level targets in the sample, wherein the target genes are selected from oncology response genes consisting of the following function: DNA hotspot mutation genes, copy number variation (CNV) genes, inter-genetic fusion genes, and intra-genetic fusion genes. In some embodiments, the target genes are selected from oncology genes consisting of one or more function of Table 1. In some embodiments, the target genes are selected from one or more actionable target genes in a sample that determines a change in oncology activity in the sample indicative of a potential diagnosis, prognosis, candidate therapeutic regimen, and/or adverse event likelihood. In total, the various functions of genes comprising the provided multiplex panel of the invention provide a comprehensive picture recommending actionable approaches to cancer therapy.

In certain embodiments, target oncology sequences are directed to sequences having mutations associated with cancer. In some embodiments, the target sequences or amplified target sequences are directed to sequences having mutations associated with one or more solid tumor cancers selected from the group consisting of head and neck cancers (e.g., HNSCC, nasopharyngeal, salivary gland), brain cancer (e.g., glioblastoma, glioma, gliosarcoma, glioblastoma multiforme, neuroblastoma), breast cancer (e.g., TNBC, trastuzumab resistant HER2+ breast cancer, ER+/HER− breast cancer), gynecological (e.g., uterine, ovarian cancer, cervical cancer, endometrial cancer, fallopian cancer), colorectal cancer, gallbladder cancer, esophageal cancer, gastrointestinal cancer, gastric cancer, bladder cancer, prostate cancer, testicular cancer, urothelial cancer, liver cancer (e.g., hepatocellular, HCC), lung cancer (e.g., non-small cell lung, small cell lung), kidney (renal cell) cancer, pancreatic cancer (e.g., adenocarcinoma, ductal), thyroid cancer, bile duct cancer, pituitary tumor, wilms tumor, kaposi sarcoma, hairy cell carcinoma, osteosarcoma, thymus cancer, skin cancer, melanoma, heart cancer, oral and larynx cancer, neuroblastoma, mesothelioma, and other solid tumors (thymic, bone, soft tissue, oral SCC, myelofibrosis, synovial sarcoma). In one embodiment, the mutations can include substitutions, insertions, inversions, point mutations, deletions, mismatches and translocations. In some embodiments, the target sequences or amplified target sequences are directed to sequences having mutations associated with one or more blood/hematologic cancers selected from the group consisting of multiple myeloma, diffuse large B cell lymphoma (DLBCL), lymphoma, Hodgkins lymphoma, non-Hodgkins lymphoma, follicular lymphoma, leukemia, acute myeloid leukemia (AML), chronic lymphocytic leukemia (CLL), myelodisplastic syndrome. In one embodiment, the mutant biomarker associated with cancer is located in at least one of the genes provided in Table 1.

In some embodiments, one or more mutant oncology sequences are located in at least one of the genes selected from, Table 1. In some embodiments the one or more mutant sequences indicate cancer activity.

In some embodiments the one or more mutant sequences indicate a patient's likelihood to response to a therapeutic agent. In some embodiments, the one or more mutant oncology biomarker sequences indication a patient's likelihood to not be responsive to a therapeutic agent. In certain embodiments, relevant therapeutic agents can be oncology therapies including but not limited to kinase inhibitors, cell signaling inhibitors, checkpoint blockades, T cell therapies, and therapeutic vaccines.

In some embodiments, target sequences or mutant target sequences are directed to mutations associated with cancer. In some embodiments, the target sequences or mutant target sequences are directed to mutations associated with one or more solid tumor cancers selected from the group consisting of head and neck cancers (e.g., HNSCC, nasopharyngeal, salivary gland), brain cancer (e.g., glioblastoma, glioma, gliosarcoma, glioblastoma multiforme, neuroblastoma), breast cancer (e.g., TNBC, trastuzumab resistant HER2+ breast cancer, ER+/HER− breast cancer), gynecological (e.g., uterine, ovarian cancer, cervical cancer, endometrial cancer, fallopian cancer), colorectal cancer, gallbladder cancer, esophageal cancer, gastrointestinal cancer, gastric cancer, bladder cancer, prostate cancer, testicular cancer, urothelial cancer, liver cancer (e.g., hepatocellular, HCC), lung cancer (e.g., non-small cell lung, small cell lung), kidney (renal cell) cancer, pancreatic cancer (e.g., adenocarcinoma, ductal), thyroid cancer, bile duct cancer, pituitary tumor, wilms tumor, kaposi sarcoma, hairy cell carcinoma, osteosarcoma, thymus cancer, skin cancer, melanoma, heart cancer, oral and larynx cancer, neuroblastoma, mesothelioma, and other solid tumors (thymic, bone, soft tissue, oral SCC, myelofibrosis, synovial sarcoma). In one embodiment, the mutations can include substitutions, insertions, inversions, point mutations, deletions, mismatches and translocations. In one embodiment, the mutations can include variation in copy number. In one embodiment, the mutations can include germline or somatic mutations. In some embodiments, the target sequences or amplified target sequences are directed to sequences having mutations associated with one or more blood/hematologic cancers selected from the group consisting of multiple myeloma, diffuse large B cell lymphoma (DLBCL), lymphoma, Hodgkins lymphoma, non-Hodgkins lymphoma, follicular lymphoma, leukemia, acute myeloid leukemia (AML), chronic lymphocytic leukemia (CLL), myelodisplastic syndrome.

In one embodiment, the mutations associated with cancer are located in at least one of the genes provided in Table 1. In some embodiments, mutant target sequences are directed to any one of more of the genes provided in Table 1. In some embodiments, mutant target sequences comprise any one or more amplicon sequences of the genes provided in Table 1. In some embodiments, mutant target sequences consist of any one or more amplicon sequences of the genes provided in Table 1. In some embodiments, mutant target sequences include amplicon sequences of each of the genes provided in Table 1.

In some embodiments, compositions comprise any one or more of oncology target-specific primer pairs provided in Table A. In some embodiments, compositions comprise all of the oncology target-specific primer pairs provided in Table A. In some embodiments, any one or more of the oncology target-specific primer pairs provided in Table A can be used to amplify a target sequence present in a sample as disclosed by the methods described herein.

In some embodiments, the oncology target-specific primers from Table A include 2, 3, 4, 5, 6, 7, 8, 9, 10, 20, 40, 60, 80, 100, 150, 200, 250, 300, 350, 400, 450, 500, 550, 600 or more, target-specific primer pairs. In some embodiments, the amplified target sequences can include any one or more of the amplified target sequences produced using target-specific primers provided in Table A. In some embodiments, at least one of the target-specific primers associated with cancer is at least 90% identical to at least one nucleic acid sequence produced using target specific primers selected from SEQ ID NOs: 1-1563. In some embodiments, at least one of the target-specific primers associated with oncology is complementary across its entire length to at least one target sequence in a sample. In some embodiments, at least one of the target-specific primers associated with immune response includes a non-cleavable nucleotide at the 3' end. In some embodiments, the non-cleavable nucleotide at the 3' end includes the terminal 3' nucleotide. In one embodiment, the amplified target sequences are directed to one or more individual exons having mutations associated with cancer. In one embodiment, the amplified target sequences are directed to individual exons having a mutation associated with cancer.

Methods

Provided methods of the invention comprise efficient procedures which enable rapid preparation of highly multiplexed libraries suitable for downstream analysis. The methods optionally allow for incorporation of one or more unique tag sequences. Certain methods comprise streamlined, addition-only procedures conveying highly rapid library generation.

Provided herein are methods for determining oncology activity in a sample. In some embodiments, the method comprises multiplex amplification of a plurality of oncology sequences from a biological sample, wherein amplifying comprises contacting at least a portion of the sample with a plurality of sets of primer pair reagents directed to the plurality of target sequences, and a polymerase under amplification conditions, to thereby produce amplified target expression sequences. The method further comprises detecting the presence of a mutation of the one or more target sequences in the sample, wherein a mutation of one or more oncology markers as compared with a control determines a change in oncology activity in the sample. In some embodiments the oncology sequences of the methods are selected from oncology response genes consisting of the following function: DNA hotspot mutation genes, copy number variation (CNV) genes, inter-genetic fusion genes, and intra-genetic fusion genes. In some embodiments, the target genes are selected from oncology genes consisting of one or more function of Table 1. In some embodiments, the target genes are selected from one or more actionable target genes in a sample that determines a change in oncology activity in the sample indicative of a potential diagnosis, prognosis, candidate therapeutic regimen, and/or adverse event likelihood. In total, the various functions of genes comprising the provided multiplex panel of the invention provide a comprehensive picture recommending actionable approaches to cancer therapy.

In certain embodiments, target oncology sequences of the methods are directed to sequences having mutations associated with cancer. In some embodiments, the target sequences or amplified target sequences are directed to sequences having mutations associated with one or more solid tumor cancers selected from the group consisting of head and neck cancers (e.g., HNSCC, nasopharyngeal, salivary gland), brain cancer (e.g., glioblastoma, glioma, gliosarcoma, glioblastoma multiforme, neuroblastoma), breast cancer (e.g., TNBC, trastuzumab resistant HER2+ breast cancer, ER+/HER− breast cancer), gynecological (e.g., uterine, ovarian cancer, cervical cancer, endometrial cancer, fallopian cancer), colorectal cancer, gallbladder cancer, esophageal cancer, gastrointestinal cancer, gastric cancer, bladder cancer, prostate cancer, testicular cancer, urothelial cancer, liver cancer (e.g., hepatocellular, HCC), lung cancer (e.g., non-small cell lung, small cell lung), kidney (renal cell) cancer, pancreatic cancer (e.g., adenocarcinoma, ductal), thyroid cancer, bile duct cancer, pituitary tumor, wilms tumor, kaposi sarcoma, hairy cell carcinoma, osteosarcoma, thymus cancer, skin cancer, melanoma, heart cancer, oral and larynx cancer, neuroblastoma, mesothelioma, and other solid tumors (thymic, bone, soft tissue, oral SCC, myelofibrosis, synovial sarcoma). In one embodiment, the mutations can include substitutions, insertions, inversions, point mutations, deletions, mismatches and translocations. In some embodiments, the target sequences or amplified target sequences are directed to sequences having mutations associated with one or more blood/hematologic cancers selected from the group consisting of multiple myeloma, diffuse large B cell lymphoma (DLBCL), lymphoma, Hodgkins lymphoma, non-Hodgkins lymphoma, follicular lymphoma, leukemia, acute myeloid leukemia (AML), chronic lymphocytic leukemia (CLL), myelodisplastic syndrome. In one embodiment, the mutant biomarker associated with cancer is located in at least one of the genes provided in Table 1.

In some embodiments, one or more mutant oncology sequences of the methods are located in at least one of the genes selected from, Table 1. In some embodiments the one or more mutant sequences indicate cancer activity.

In some embodiments the one or more mutant sequences of the methods indicate a patient's likelihood to response to a therapeutic agent. In some embodiments, the one or more mutant oncology biomarker sequences indication a patient's likelihood to not be responsive to a therapeutic agent. In certain embodiments, relevant therapeutic agents can be oncology therapies including but not limited to kinase inhibitors, cell signaling inhibitors, checkpoint blockades, T cell therapies, and therapeutic vaccines.

In some embodiments, target sequences or mutant target sequences of the methods are directed to mutations associated with cancer. In some embodiments, the target sequences or mutant target sequences of the methods are directed to mutations associated with one or more solid tumor cancers selected from the group consisting of head and neck cancers (e.g., HNSCC, nasopharyngeal, salivary gland), brain cancer (e.g., glioblastoma, glioma, gliosarcoma, glioblastoma multiforme, neuroblastoma), breast cancer (e.g., TNBC, trastuzumab resistant HER2+ breast cancer, ER+/HER− breast cancer), gynecological (e.g., uterine, ovarian cancer, cervical cancer, endometrial cancer, fallopian cancer), colorectal cancer, gallbladder cancer, esophageal cancer, gastrointestinal cancer, gastric cancer, bladder cancer, prostate cancer, testicular cancer, urothelial cancer, liver cancer (e.g., hepatocellular, HCC), lung cancer (e.g., non-small cell lung, small cell lung), kidney (renal cell) cancer, pancreatic cancer (e.g., adenocarcinoma, ductal), thyroid cancer, bile duct cancer, pituitary tumor, wilms tumor, kaposi sarcoma, hairy cell carcinoma, osteosarcoma, thymus cancer, skin cancer, melanoma, heart cancer, oral and larynx cancer, neuroblastoma, mesothelioma, and other solid tumors (thymic, bone, soft tissue, oral SCC, myelofibrosis, synovial sarcoma). In one embodiment, the mutations can include substitutions, insertions, inversions, point mutations, deletions, mismatches and translocations. In one embodiment, the mutations can include variation in copy number. In one embodiment, the mutations can include germline or somatic mutations. In some embodiments, the target sequences or amplified target sequences are directed to sequences having mutations associated with one or more blood/hematologic cancers selected from the group consisting of multiple myeloma, diffuse large B cell lymphoma (DLBCL), lymphoma, Hodgkins lymphoma, non-Hodgkins lymphoma, follicular lymphoma, leukemia, acute myeloid leukemia (AML), chronic lymphocytic leukemia (CLL), myelodysplastic syndrome.

In one embodiment, the mutations associated with cancer are located in at least one of the genes provided in Table 1. In some embodiments, mutant target sequences are directed to any one of more of the genes provided in Table 1. In some embodiments, mutant target sequences comprise any one or more amplicon sequences of the genes provided in Table 1. In some embodiments, mutant target sequences consist of any one or more amplicon sequences of the genes provided in Table 1. In some embodiments, mutant target sequences include amplicon sequences of each of the genes provided in Table 1.

In some embodiments, methods comprise use of any one or more of oncology target-specific primer pairs provided in Table A. In some embodiments, methods comprise use of all of the oncology target-specific primer pairs provided in Table A. In some embodiments, use of any one or more of the oncology target-specific primer pairs provided in Table A can be used to amplify a target sequence present in a sample as disclosed by the methods described herein.

In some embodiments, methods comprise use of the oncology target-specific primers from Table A include 2, 3, 4, 5, 6, 7, 8, 9, 10, 20, 40, 60, 80, 100, 150, 200, 250, 300, 350, 400, 450, 500, 550, 600 or more, target-specific primer pairs. In some embodiments, methods comprising detection of amplified target sequences can include any one or more of the amplified target sequences produced using target-specific primers provided in Table A. In some embodiments, methods comprise use of at least one of the target-specific primers associated with cancer is at least 90% identical to at least one nucleic acid sequence produced using target specific primers selected from SEQ ID NOs: 1-1563. In some embodiments, at least one of the target-specific primers associated with oncology is complementary across its entire length to at least one target sequence in a sample. In some embodiments, at least one of the target-specific primers associated with immune response includes a non-cleavable nucleotide at the 3' end. In some embodiments, the non-cleavable nucleotide at the 3' end includes the terminal 3' nucleotide. In one embodiment, the amplified target sequences are directed to one or more individual exons having mutations associated with cancer. In one embodiment, the amplified target sequences of the methods are directed to individual exons having a mutation associated with cancer.

In some embodiments, methods comprise detection and optionally, the identification of clinically actionable markers. As defined herein, the term "clinically actionable marker" includes clinically actionable mutations and/or clinically actionable expression patterns that are known or can be associated by one of ordinary skill in the art with, but not limited to, prognosis for the treatment of cancer. In one embodiment, prognosis for the treatment of cancer includes the identification of mutations and/or expression patterns associated with responsiveness or non-responsiveness of a cancer to a drug, drug combination, or treatment regime. In one embodiment, methods comprise amplification of a plurality of target sequences from a population of nucleic acid molecules linked to, or correlated with, the onset, progression or remission of cancer. In some embodiments, provided methods comprise selective amplification of more than one target sequences in a sample and the detection and/or identification of mutations associated with cancer. In some embodiments, the amplified target sequences include two or more nucleotide sequences of the genes provided in Table 1.

In some embodiments, the amplified target sequences can include any one or more the amplified target sequences generated using the target-specific primers provided in Table A. In one embodiment, the amplified target sequences include 10, 50, 100, 150, 200, 250, 300, 350, 400, 450, 500, 550, 600 or more amplicons of the genes from Table 1.

In one aspect of the invention, methods for preparing a library of target nucleic acid sequences are provided. In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons; then amplifying the repaired target amplicons in a second amplification using universal primers, thereby producing a library of target nucleic acid sequences. Each of the plurality of adaptors used in the methods herein comprise a universal handle sequence and a target nucleic acid sequence and a cleavable moiety and optionally one or more tag sequences. At least two and up to one hundred thousand target specific adaptor pairs are included in the provided methods, wherein the target nucleic acid sequence of each adaptor includes at least one cleavable moiety and the universal handle sequence does not include the cleavable moiety. In some embodiments where an optional tag sequence is included in at least one adaptor, the cleavable moieties are included in the adaptor sequence flanking either end of the tag sequence.

In one aspect of the invention, methods for preparing a tagged library of target nucleic acid sequences are provided. In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons; then amplifying the repaired target amplicons in a second amplification using universal primers, thereby producing a library of target nucleic acid sequences. Each of the plurality of adaptors used in the methods herein comprise a universal handle sequence and a target nucleic acid sequence and a cleavable moiety and one or more tag sequences. At least two and up to one hundred thousand target specific adaptor pairs are included in the provided methods, wherein the target nucleic acid sequence of each adaptor includes at least one cleavable moiety, the universal handle sequence does not include the cleavable moiety, and the cleavable moieties are included flanking either end of the tag sequence.

In certain embodiments, the comparable maximal minimum melting temperature of each universal sequence is higher than the comparable maximal minimum melting temperature of each target nucleic acid sequence and each tag sequence present in an adaptor.

In some embodiments, each of the adaptors comprise unique tag sequences as further described herein and each further comprise cleavable groups flanking either end of the tag sequence in each adaptor. In some embodiments wherein unique taq sequences are employed, each generated target specific amplicon sequence includes at least 1 different sequence and up to $10^7$ different sequences. In certain embodiments each target specific pair of the plurality of adaptors includes up to 16,777,216 different adaptor combinations comprising different tag sequences.

In some embodiments, methods comprise contacting the plurality of gapped polynucleotide products with digestion and repair reagents simultaneously. In some embodiments, methods comprise contacting the plurality of gapped polynucleotide products sequentially with the digestion then repair reagents.

A digestion reagent useful in the methods provided herein comprises any reagent capable of cleaving the cleavable site present in adaptors, and in some embodiments includes, but is not limited to, one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta.

A repair reagent useful in the methods provided herein comprises any reagent capable of repair of the gapped amplicons, and in some embodiments includes, but is not limited to, any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, E. coli DNA ligase, T3 DNA ligase, T4 DNA ligase, T7 DNA ligase, Taq DNA ligase, and/or 9° N DNA ligase.

Thus, in certain embodiments, a digestion and repair reagent comprises any one or a combination of one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta; and any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, E. coli DNA ligase, T3 DNA ligase, T4 DNA ligase, T7 DNA ligase, Taq DNA ligase, and/or 9° N DNA ligase. In certain embodiments, a digestion and repair reagent comprises any one or a combination of uracil DNA glycosylase (UDG), apurinic endonuclease (e.g., APE1), Taq DNA polymerase, Phusion U DNA polymerase, SuperFiU DNA polymerase, T7 DNA ligase. In certain embodiments, a digestion and repair reagent comprises any one or a combination of uracil DNA glycosylase (UDG), formamidopyrimidine [fapy]-DNA glycosylase (fpg), Phusion U DNA polymerase, Taq DNA polymerase, SuperFiU DNA polymerase, T4 PNK and T7 DNA ligase.

In some embodiments, methods comprise the digestion and repair steps carried out in a single step. In other embodiments, methods comprise the digestion and repair of steps carried out in a temporally separate manner at different temperatures.

In some embodiments methods of the invention are carried out wherein one or more of the method steps is conducted in manual mode. In particular embodiments, methods of the invention are carried out wherein each of the method steps is conducted manually. In some embodiments methods of the invention are carried out wherein one or more of the method steps is conducted in an automated mode. In particular embodiments, methods of the invention are carried wherein each of the method steps is automated.

In some embodiments methods of the invention are carried out wherein one or more of the method steps is conducted in a combination of manual and automated modes.

In some embodiments, methods of the invention comprise at least one purification step. For example, in certain embodiments a purification step is carried out only after the second amplification of repaired amplicons. In some embodiments two purification steps are utilized, wherein a first purification step is carried out after the digestion and repair and a second purification step is carried out after the second amplification of repaired amplicons.

In some embodiments a purification step comprises conducting a solid phase adherence reaction, solid phase immobilization reaction or gel electrophoresis. In certain embodiments a purification step comprises separation conducted using Solid Phase Reversible Immobilization (SPRI) beads. In particular embodiments a purification step comprises separation conducted using SPRI beads wherein the SPRI beads comprise paramagnetic beads.

In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons, then purifying repaired amplicons; then amplifying the repaired target amplicons in a second amplification using universal primers, thereby producing a library of target nucleic acid sequences; and then purifying resulting library. Each of the plurality of adaptors used in the methods herein comprise a universal handle sequence and a target nucleic acid sequence and a cleavable moiety and optionally one or more tag sequences. At least two and up to one hundred thousand target specific adaptor pairs are included in the provided methods, wherein the target nucleic acid sequence of each adaptor includes at least one cleavable moiety and the universal handle sequence does not include the cleavable moiety. In some embodiments where an optional tag sequence is included in at least one adaptor, the cleavable moieties are included in the adaptor sequence flanking either end of the tag sequence.

In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons, and purifying repaired amplicons; then amplifying the repaired target amplicons in a second amplification using universal primers, thereby producing a library of target nucleic acid sequences; and then purifying resulting library. Each of the plurality of adaptors used in the methods herein comprise a universal handle sequence and a target nucleic acid sequence and a cleavable moiety and one or more tag sequences. At least two and up to one hundred thousand target specific adaptor pairs are included in the provided methods, wherein the target nucleic acid sequence of each adaptor includes at least one cleavable moiety, the universal handle sequence does not include the cleavable moiety, and cleavable moieties are included in the flanking either end of the tag sequence.

In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons, then purifying repaired amplicons; then amplifying the repaired target amplicons in a second amplification using universal primers, thereby producing a library of target nucleic acid sequences; and then purifying resulting library. Each of the plurality of adaptors used in the methods herein comprise a universal handle sequence and a target nucleic acid sequence and a cleavable moiety and optionally one or more tag sequences. At least two and up to one hundred thousand target specific adaptor pairs are included in the provided methods, wherein the target nucleic acid sequence of each adaptor includes at least one cleavable moiety and the universal handle sequence does not include the cleavable moiety. In some embodiments where an optional tag sequence is included in at least one adaptor, the cleavable moieties are included in the adaptor sequence flanking either end of the tag sequence. In some embodiments a digestion and repair reagent comprises any one or a combination of one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta; and any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, *E. coli* DNA ligase, T3 DNA ligase, T4 DNA ligase, T7 DNA ligase, Taq DNA ligase, and/or 9° N DNA ligase. In certain embodiments, a digestion and repair reagent comprises any one or a combination of uracil DNA glycosylase (UDG), apurinic endonuclease (e.g., APE1), Taq DNA polymerase, Phusion U DNA polymerase, SuperFiU DNA polymerase, T7 DNA ligase. In certain embodiments, a digestion and repair reagent comprises any one or a combination of uracil DNA glycosylase (UDG), formamidopyrimidine [fapy]-DNA glycosylase (fpg), Phusion U DNA polymerase, Taq DNA polymerase, SuperFiU DNA polymerase, T4 PNK and T7 DNA ligase.

In some embodiments, methods comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons, and purifying repaired amplicons; then amplifying the repaired target amplicons in a second amplification using universal primers, thereby producing a library of target nucleic acid sequences; and then purifying resulting library. Each of the plurality of adaptors used in the methods herein comprise a universal handle sequence and a target nucleic acid sequence and a cleavable moiety and one or more tag sequences. At least two and up to one hundred thousand target specific adaptor pairs are included in the provided methods, wherein the target nucleic acid sequence of each adaptor includes at least one cleavable moiety, the universal handle sequence does not include the cleavable moiety, and cleavable moieties are included in the flanking either end of the tag sequence. In some embodiments a digestion and repair reagent comprises any one or a combination of one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta; and any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, *E. coli* DNA ligase, T3 DNA ligase, T4 DNA ligase, T7 DNA ligase, Taq DNA ligase, and/or 9°N DNA ligase. In certain embodiments, a digestion and repair reagent comprises any one or a combination of uracil DNA glycosylase (UDG), apurinic endonuclease (e.g., APE1), Taq DNA polymerase, Phusion U DNA polymerase, SuperFiU DNA polymerase, T7 DNA ligase. In certain embodiments, a digestion and repair reagent comprises any one or a combination of uracil DNA glycosylase (UDG), formamidopyrimidine [fapy]-DNA glycosylase (fpg), Phusion U DNA polymerase, Taq DNA polymerase, SuperFiU DNA polymerase, T4 PNK and T7 DNA ligase.

In certain embodiments methods of the invention are carried out in a single, addition only workflow reaction, allowing for rapid production of highly multiplexed targeted libraries. For example, in one embodiment, methods for preparing a library of target nucleic acid sequences comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons; then amplifying the repaired target amplicons in a second amplification using universal primers, thereby producing a library of target nucleic acid sequences, and purifying the resulting library. In certain embodiments the purification comprises a single or repeated separating step that is carried out following production of the library following the second amplification; and wherein the other method steps are conducted in a single reaction vessel without requisite transferring of a portion (aliquot) of any of the products generated in steps to another reaction vessel. Each of the plurality of adaptors used in the methods herein comprise a universal handle sequence and a target nucleic acid sequence and a cleavable moiety and optionally one or more tag sequences. At least two and up to one hundred thousand target specific adaptor pairs are included in the provided methods, wherein the target nucleic acid sequence of each adaptor includes at least one cleavable moiety and the universal handle sequence does not include the cleavable moiety. In some embodiments where an optional tag sequence is included in at least one adaptor, the cleavable moieties are included in the adaptor sequence flanking either end of the tag sequence.

In another embodiment, methods for preparing a tagged library of target nucleic acid sequences are provided comprising contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons; then amplifying the repaired target amplicons in a second amplification using universal primers, thereby producing a library of target nucleic acid sequences, and purifying the resulting library. In certain embodiments the purification comprises a single or repeated separating step; and wherein the other method steps are optionally conducted in a single reaction vessel without requisite transferring of a portion of any of the products generated in steps to another reaction vessel. Each of the plurality of adaptors used in the methods herein comprise a universal handle sequence and a target nucleic acid sequence and a cleavable moiety and one or more tag sequences. At least two and up to one hundred thousand target specific adaptor pairs are included in the provided methods, wherein the target nucleic acid sequence of each adaptor includes at least one cleavable moiety, the universal handle sequence does not include the cleavable moiety, and the cleavable moieties are included flanking either end of the tag sequence.

In one embodiment, methods for preparing a library of target nucleic acid sequences comprise contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicon; then amplifying the repaired target amplicons in a second amplification using universal primers, thereby producing a library of target nucleic acid sequences, and purifying the resulting library.

In some embodiments a digestion reagent comprises any one or any combination of: uracil DNA glycosylase (UDG). AP endonuclease (APE1), RecJf, formamidopyrimidine [fapy]-DNA glycosylase (fpg), Nth endonuclease III, endonuclease VIII, polynucleotide kinase, Taq DNA polymerase, DNA polymerase I and/or human DNA polymerase beta. In certain embodiments a digestion reagent comprises any one or any combination of: uracil DNA glycosylase (UDG). AP endonuclease (APE1), RecJf, formamidopyrimidine [fapy]-DNA glycosylase (fpg), Nth endonuclease III, endonuclease VIII, polynucleotide kinase, Taq DNA polymerase, DNA polymerase I and/or human DNA polymerase beta wherein the digestion reagent lacks formamidopyrimidine [fapy]-DNA glycosylase (fpg).

In some embodiments a digestion reagent comprises a single-stranded DNA exonuclease that degrades in a 5'-3' direction. In some embodiments a cleavage reagent comprises a single-stranded DNA exonuclease that degrades abasic sites. In some embodiments herein the digestions reagent comprises an RecJf exonuclease. In particular embodiments a digestion reagent comprises APE1 and RecJf, wherein the cleavage reagent comprises an apurinic/apyrimidinic endonuclease. In certain embodiments the digestion reagent comprises an AP endonuclease (APE1).

In some embodiments a repair reagent comprises at least one DNA polymerase; wherein the gap-filling reagent comprises: any one or any combination of: Phusion DNA polymerase, Phusion U DNA polymerase, SuperFi DNA polymerase, Taq DNA polymerase, Human DNA polymerase beta, T4 DNA polymerase and/or T7 DNA polymerase and/or SuperFi U DNA polymerase. In some embodiments a repair reagent further comprises a plurality of nucleotides.

In some embodiment a repair reagent comprises an ATP-dependent or an ATP-independent ligase; wherein the repair reagent comprises any one or any combination of: E. coli DNA ligase, T3 DNA ligase, T4 DNA ligase, T7 ligase, Taq DNA ligase., 9°N DNA ligase In certain embodiments a digestion and repair reagent comprises any one or a combination of one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta; and any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, E. coli DNA ligase, T3 DNA ligase, T4 DNA ligase, T7 DNA ligase, Taq DNA ligase, and/or 9°N DNA ligase. In particular embodiments, a digestion and repair reagent comprises any one or a combination of uracil DNA glycosylase (UDG), apurinic endonuclease (e.g., APE1), Taq DNA polymerase, Phusion U DNA polymerase, SuperFiU DNA polymerase, T7 DNA ligase. In certain embodiments a purification comprises a single or repeated separating step that is carried out following production of the library following the second amplification; and wherein method steps are conducted in a single reaction vessel without requisite transferring of a portion of any of the products generated in steps to another reaction vessel until a first purification. Each of the plurality of adaptors used in the methods herein comprise a universal handle sequence and a target nucleic acid sequence and a cleavable moiety and optionally one or more tag sequences. At least two and up to one hundred thousand target specific adaptor pairs are included in the provided methods, wherein the target nucleic acid sequence of each adaptor includes at least one cleavable moiety and the universal handle sequence does not include the cleavable moiety. In some embodiments where an optional tag sequence is included in at least one adaptor, the cleavable moieties are included in the adaptor sequence flanking either end of the tag sequence.

In another embodiment, methods for preparing a tagged library of target nucleic acid sequences are provided comprising contacting a nucleic acid sample with a plurality of adaptors capable of amplification of one or more target nucleic acid sequences in the sample under conditions wherein the target nucleic acid(s) undergo a first amplification; digesting resulting first amplification products to reduce or eliminate resulting primer dimers and prepare partially digested target amplicons, thereby producing gapped, double stranded amplicons. The methods further comprise repairing the partially digested target amplicons; then amplifying the repaired target amplicons in a second amplification using universal primers, thereby producing a library of target nucleic acid sequences, and purifying the resulting library. In certain embodiments a digestion and repair reagent comprises any one or a combination of one or a combination of uracil DNA glycosylase (UDG). apurinic endonuclease (e.g., APE1), RecJf, formamidopyrimidine [fapy]-DNA glycosylase (fpg), Nth endonuclease III, endonuclease VIII, polynucleotide kinase (PNK), Taq DNA polymerase, DNA polymerase I and/or human DNA polymerase beta; and any one or a combination of Phusion DNA polymerase, Phusion U DNA polymerase, SuperFi DNA polymerase, Taq DNA polymerase, Human DNA polymerase beta, T4 DNA polymerase and/or T7 DNA polymerase, SuperFiU DNA polymerase, *E. coli* DNA ligase, T3 DNA ligase, T4 DNA ligase, T7 DNA ligase, Taq DNA ligase, and/or 9°N DNA ligase. In particular embodiments, a digestion and repair reagent comprises any one or a combination of uracil DNA glycosylase (UDG), apurinic endonuclease (e.g., APE1), Taq DNA polymerase, Phusion U DNA polymerase, SuperFiU DNA polymerase, T7 DNA ligase. In certain embodiments the purification comprises a single or repeated separating step that is carried out following production of the library following the second amplification; and wherein steps the other method steps are conducted in a single reaction vessel without requisite transferring of a portion (aliquot) of any of the products generated in steps to another reaction vessel. Each of the plurality of adaptors used in the methods herein comprise a universal handle sequence and a target nucleic acid sequence and a cleavable moiety and one or more tag sequences. At least two and up to one hundred thousand target specific adaptor pairs are included in the provided methods, wherein the target nucleic acid sequence of each adaptor includes at least one cleavable moiety, the universal handle sequence does not include the cleavable moiety, and the cleavable moieties are included flanking either end of the tag sequence.

In some embodiments, adaptor-dimer byproducts resulting from the first amplification of step of the methods are largely removed from the resulting library. In certain embodiments the enriched population of amplified target nucleic acids contains a reduced amount of adaptor-dimer byproduct. In particular embodiments adaptor dimer byproducts are eliminated.

In some embodiments, the library is prepared in less than 4 hours. In some embodiments, the library is prepared, enriched and sequenced in less than 3 hours. In some embodiments, the library is prepared, enriched and sequenced in 2 to 3 hours. In some embodiments, the library is prepared in approximately 2.5 hours. In some embodiments, the library is prepared in approximately 2.75 hours. In some embodiments, the library is prepared in approximately 3 hours.

Compositions

Additional aspects of the invention comprise composition comprising a plurality of nucleic acid adaptors, as well as library compositions prepared according to the methods of the invention. Provided compositions are useful in conjunction with the methods described herein as well as for additional analysis and applications known in the art.

Thus, provided are composition comprising a plurality of nucleic acid adaptors, wherein each of the plurality of adaptors comprises a 5' universal handle sequence, optionally one or more tag sequences, and a 3' target nucleic acid sequence wherein each adaptor comprises a cleavable moiety, wherein the target nucleic acid sequence of the adaptor includes at least one cleavable moiety, and when tag sequences are present cleavable moieties are included flanking either end of the tag sequence and wherein the universal handle sequence does not include the cleavable moiety. At least two and up to one hundred thousand target specific adaptor pairs are included in provided compositions. Provided composition allow for rapid production of highly multiplexed targeted libraries.

In some embodiments, provided compositions comprise plurality of nucleic acid adaptors, wherein each of the plurality of adaptors comprise a 5' universal handle sequence, one or more tag sequences, and a 3' target nucleic acid sequence wherein each adaptor comprises a cleavable moiety; wherein the target nucleic acid sequence of the adaptor includes at least one cleavable moiety, cleavable moieties are included flanking either end of the tag sequence and the universal handle sequence does not include the cleavable moiety. At least two and up to one hundred thousand target specific adaptor pairs are included in provided compositions. Provided composition allow for rapid production of highly multiplexed, tagged, targeted libraries.

Primer/adaptor compositions may be single stranded or double stranded. In some embodiments adaptor compositions comprise are single stranded adaptors. In some embodiments adaptor compositions comprise double stranded adaptors. In some embodiments adaptor compositions comprise a mixture of single stranded and double stranded adaptors.

In some embodiments, compositions include a plurality of adaptors capable of amplification of one or more target nucleic acid sequences comprising a multiplex of adaptor pairs capable of amplification of at least two different target nucleic acid sequences wherein the target-specific primer sequence is substantially non-complementary to other target specific primer sequences in the composition. In some embodiments, the composition comprises at least 25, 50, 75, 100, 150, 200, 250, 300, 350, 400, 450, 500, 750, 1000, 1250, 1500, 1750, 2000, 2250, 2500, 2750, 3000, 3250, 3500, 3750, 4000, 4500, 5000, 5500, 6000, 7000, 8000, 9000, 10000, 11000, or 12000, or more target-specific adaptor pairs. In some embodiments, target-specific adpator pairs comprise about 15 nucleotides to about 40 nucleotides in length, wherein at least one nucleotide is replaced with a cleavable group. In some embodiments the cleavable group is a uridine nucleotide. In some embodiments, the target-specific adaptor pairs are designed to amplify an exon, gene, exome or region of the genome associated with a clinical or pathological condition, e.g., amplification of one or more sites comprising one or more mutations (e.g., driver mutation) associated with a cancer, e.g., lung, colon, breast cancer, etc., or amplification of mutations associated with an inherited disease, e.g., cystic fibrosis, muscular dystrophies, etc. In some embodiments, the target-specific adaptor pairs when hybridized to a target sequence and amplified as provided herein generates a library of adaptor-ligated amplified target sequences that are about 100 to about 600 base pairs in length. In some embodiments, no one adaptor-ligated amplified target sequence is overexpressed in the library by more than 30% as compared to the remainder of other adaptor-ligated amplified target sequences in the library. In some embodiments, an adaptor-ligated amplified target sequence library is substantially homogenous with respect to GC content, amplified target sequence length or melting temperature (Tm) of the respective target sequences.

In some embodiments, the target-specific primer sequences of adaptor pairs in the compositions of the invention are target-specific sequences that can amplify specific regions of a nucleic acid molecule. In some embodiments, the target-specific adaptors can amplify genomic DNA or cDNA. In some embodiments, target-specific adaptors can amplify mammalian nucleic acid, such as, but not limited to human DNA or RNA, murine DNA or RNA, bovine DNA or RNA, canine DNA or RNA, equine DNA or RNA, or any other mammal of interest. In other embodiments, target specific adaptors include sequences directed to amplify plant nucleic acids of interest. In other embodiments, target specific adaptors include sequences directed to amplify infectious agents, e.g., bacterial and/or viral nucleic acids. In some embodiments, the amount of nucleic acid required for selective amplification is from about 1 ng to 1 microgram. In some embodiments, the amount of nucleic acid required for selective amplification of one or more target sequences is about 1 ng, about 5 ng or about 10 ng. In some embodiments, the amount of nucleic acid required for selective amplification of target sequence is about 10 ng to about 200 ng.

As described herein, each of the plurality of adaptors comprises a 5' universal handle sequence. In some embodiments a universal handle sequence comprises any one or any combination of an amplification primer binding sequence, a sequencing primer binding sequence and/or a capture primer binding sequence. In some embodiments the comparable maximal minimum melting temperatures of each adaptor universal handle sequence is higher than the comparable maximal minimum melting temperatures of each target nucleic acid sequence and each tag sequence present in the same adaptor. Preferably, the universal handle sequences of provided adaptors do not exhibit significant complementarity and/or hybridization to any portion of a unique tag sequence and/or target nucleic acid sequence of interest. In some embodiments a first universal handle sequence comprises any one or any combination of an amplification primer binding sequence, a sequencing primer binding sequence and/or a capture primer binding sequence. In some embodiments a second universal handle sequence comprises any one or any combination of an amplification primer binding sequence, a sequencing primer binding sequence and/or a capture primer binding sequence. In certain embodiments first and second universal handle sequences correspond to forward and reverse universal handle sequences and in certain embodiments the same first and second universal handle sequences are included for each of the plurality of target specific adaptor pairs. Such forward and reverse universal handle sequences are targeted in conjunction with universal primers to carry out a second amplification of repaired amplicons in production of libraries according to methods of the invention. In certain embodiments a first 5' universal handle sequence comprises two universal handle sequences (e.g., a combination of an amplification primer binding sequence, a sequencing primer binding sequence and/or a capture primer binding sequence); and a second 5' universal sequence comprises two universal handle sequences (e.g., a combination of an amplification primer binding sequence, a sequencing primer binding sequence and/or a capture primer binding sequence), wherein the 5' first and second universal handle sequences do not exhibit significant hybridization to any portion of a target nucleic acid sequence of interest.

The structure and properties of universal amplification primers or universal primers are well known to those skilled in the art and can be implemented for utilization in conjunction with provided methods and compositions to adapt to specific analysis platforms. Universal handle sequences of the adaptors provided herein are adapted accordingly to accommodate a preferred universal primer sequences. For example, e.g., as described herein universal P1 and A primers with optional barcode sequences have been described in the art and utilized for sequencing on Ion Torrent sequencing platforms (Ion Xpress™ Adapters, Thermo Fisher Scientific). Similarly, additional and other universal adaptor/primer sequences described and known in the art (e.g., Illumina universal adaptor/primer sequences can be found, e.g., at https://support.illumina.com/content/dam/illumina-support/documents/documentation/chemistry_documentation/experiment-design/illumina-adapter-sequences_1000000002694-01.pdf; PacBio universal adaptor/primer sequences, can be found, e.g., at https://s3.amazonaws.com/files.pacb.com/pdf/Guide_Pacific_Biosciences_Template_Preparation-and_Sequencing.pdf; etc.) can be used in conjunction with the methods and compositions provided herein. Suitable universal primers of appropriate nucleotide sequence for use with adaptors of the invention are readily prepared using standard automated nucleic acid synthesis equipment and reagents in routine use in the art. One single type of universal primer or separate types (or even a mixture) of two different universal primers, for example a pair of universal amplification primers suitable for amplification of repaired amplicons in a second amplification are included for use in the methods of the invention. Universal primers optionally include a different tag (barcode) sequence, where the tag (barcode) sequence does not hybridize to the adaptor. Barcode sequences incorporated into amplicons in a second universal amplification can be utilized e.g., for effective identification of sample source.

In some embodiments adaptors further comprise a unique tag sequence located between the 5' first universal handle sequence and the 3' target-specific sequence, and wherein the unique tag sequence does not exhibit significant complementarity and/or hybridization to any portion of a unique tag sequence and/or target nucleic acid sequence of interest. In some embodiments the plurality of primer adaptor pairs has $10^4$-$10^9$ different tag sequence combinations. Thus in certain embodiments each generated target specific adaptor pair comprises $10^4$-$10^9$ different tag sequences. In some embodiments the plurality of primer adaptors comprise each target specific adaptor comprising at least 1 different unique tag sequence and up to $10^5$ different unique tag sequences. In some embodiments the plurality of primer adaptors comprise each target specific adaptor comprising at least 1 different unique tag sequence and up to $10^5$ different unique tag sequences. In certain embodiments each generated target specific amplicon generated comprises at least two and up to $10^9$ different adaptor combinations comprising different tag sequences, each having two different unique tag sequences. In some embodiments the plurality of primer adaptors comprise each target specific adaptor comprising 4096 different tag sequences. In certain embodiments each generated target specific amplicon generated comprises up to 16,777,216 different adaptor combinations comprising different tag sequences, each having two different unique tag sequences.

In some embodiments individual primer adaptors in the plurality of adaptors include a unique tag sequence (e.g., contained in a tag adaptor) comprising different random tag sequences alternating with fixed tag sequences. In some embodiments, the at least one unique tag sequence comprises a at least one random sequence and at least one fixed sequence, or comprises a random sequence flanked on both sides by a fixed sequence, or comprises a fixed sequence flanked on both sides by a random sequence. In some embodiments a unique tag sequence includes a fixed sequence that is 2-2000 nucleotides or base-pairs in length. In some embodiments a unique tag sequence includes a random sequence that is 2-2000 nucleotides or base-pairs in length.

In some embodiments, unique tag sequences include a sequence having at least one random sequence interspersed with fixed sequences. In some embodiments, individual tag sequences in a plurality of unique tags have the structure $(N)_n(X)_x(M)_m(Y)_y$, wherein "N" represents a random tag sequence that is generated from A, G, C, T, U or I, and wherein "n" is 2-10 which represents the nucleotide length of the "N" random tag sequence; wherein "X" represents a fixed tag sequence, and wherein "x" is 2-10 which represents the nucleotide length of the "X" random tag sequence; wherein "M" represents a random tag sequence that is generated from A, G, C, T, U or I, wherein the random tag sequence "M" differs or is the same as the random tag sequence "N", and wherein "m" is 2-10 which represents the nucleotide length of the "M" random tag sequence; and wherein "Y" represents a fixed tag sequence, wherein the fixed tag sequence of "Y" is the same or differs from the fixed tag sequence of "X", and wherein "y" is 2-10 which represents the nucleotide length of the "Y" random tag sequence. In some embodiments, the fixed tag sequence "X" is the same in a plurality of tags. In some embodiments, the fixed tag sequence "X" is different in a plurality of tags. In some embodiments, the fixed tag sequence "Y" is the same in a plurality of tags. In some embodiments, the fixed tag sequence "Y" is different in a plurality of tags. In some embodiments, the fixed tag sequences "$(X)_x$" and "$(Y)_y$" within the plurality of adaptors are sequence alignment anchors.

In some embodiments, the random sequence within a unique tag sequence is represented by "N", and the fixed sequence is represented by "X". Thus, a unique tag sequence is represented by $N_1N_2N_3X_1X_2X_3$ or by $N_1N_2N_3X_1X_2X_3N_4N_5N_6X_4X_5X_6$. Optionally, a unique tag sequence can have a random sequence in which some or all of the nucleotide positions are randomly selected from a group consisting of A, G, C, T, U and I. For example, a nucleotide for each position within a random sequence is independently selected from any one of A, G, C, T, U or I, or is selected from a subset of these six different types of nucleotides. Optionally, a nucleotide for each position within a random sequence is independently selected from any one of A, G, C or T. In some embodiments, the first fixed tag sequence "$X_1X_2X_3$" is the same or different sequence in a plurality of tags. In some embodiments, the second fixed tag sequence "$X_4X_5X_6$" is the same or different sequence in a plurality of tags. In some embodiments, the first fixed tag sequence "$X_1X_2X_3$" and the second fixed tag sequence "$X_4X_5X_6$" within the plurality of adaptors are sequence alignment anchors.

In some embodiments, a unique tag sequence comprises the sequence 5'-NNNACTNNNTGA-3', where "N" represents a position within the random sequence that is generated randomly from A, G, C or T, the number of possible distinct random tags is calculated to be $4^6$ (or 4^6) is about 4096, and the number of possible different combinations of two unique tags is $4^{12}$ (or 4^12) is about 16.78 million. In some embodiments, the underlined portions of 5'-<u>NNN</u>CT<u>NNN</u>TGA-3' are a sequence alignment anchor.

In some embodiments, the fixed sequences within the unique tag sequence is a sequence alignment anchor that can be used to generate error-corrected sequencing data. In some embodiments fixed sequences within the unique tag sequence is a sequence alignment anchor that can be used to generate a family of error-corrected sequencing reads.

Adaptors provided herein comprise at least one cleavable moiety. In some embodiments a cleavable moiety is within the 3' target-specific sequence. In some embodiments a cleavable moiety is at or near the junction between the 5' first universal handle sequence and the 3' target-specific sequence. In some embodiments a cleavable moiety is at or near the junction between the 5' first universal handle sequence and the unique tag sequence, and at or near the junction between the unique tag sequence and the 3' target-specific sequence. The cleavable moiety can be present in a modified nucleotide, nucleoside or nucleobase. In some embodiments, the cleavable moiety can include a nucleobase not naturally occurring in the target sequence of interest.

In some embodiments the at least one cleavable moiety in the plurality of adaptors is a uracil base, uridine or a deoxyuridine nucleotide. In some embodiments a cleavable moiety is within the 3' target-specific sequence and the junctions between the 5' universal handle sequence and the unique tag sequence and/or the 3'target specific sequence wherein the at least one cleavable moiety in the plurality of adaptors is cleavable with uracil DNA glycosylase (UDG). In some embodiments, a cleavable moiety is cleaved, resulting in a susceptible abasic site, wherein at least one enzyme capable of reacting on the abasic site generates a gap comprising an extendible 3' end. In certain embodiments the resulting gap comprises a 5'-deoxyribose phosphate group. In certain embodiments the resulting gap comprises an extendible 3' end and a 5' ligatable phosphate group.

In another embodiment, inosine can be incorporated into a DNA-based nucleic acid as a cleavable group. In one exemplary embodiment, EndoV can be used to cleave near the inosine residue. In another exemplary embodiment, the enzyme hAAG can be used to cleave inosine residues from a nucleic acid creating abasic sites.

Where a cleavable moiety is present, the location of the at least one cleavable moiety in the adaptors does not significantly change the melting temperature (Tm) of any given double-stranded adaptor in the plurality of double-stranded adaptors. The melting temperatures (Tm) of any two given double-stranded adaptors from the plurality of double-stranded adaptors are substantially the same, wherein the melting temperatures (Tm) of any two given double-stranded adaptors does not differ by more than 10° C. of each other. However, within each of the plurality of adaptors, the melting temperatures of sequence regions differs, such that the comparable maximal minimum melting temperature of, for example, the universal handle sequence, is higher than the comparable maximal minimum melting temperatures of either the unique tag sequence and/or the target specific sequence of any adaptor. This localized differential in comparable maximal minimum melting temperatures can be adjusted to optimize digestion and repair of amplicons and ultimately improved effectiveness of the methods provided herein.

Further provided are compositions comprising a nucleic acid library generated by methods of the invention. Thus, provided are composition comprising a plurality of amplified target nucleic acid amplicons, wherein each of the plurality of amplicons comprises a 5' universal handle sequence, optionally a first unique tag sequences, an intermediate target nucleic acid sequence, optionally a second unique tag sequences and a 3' universal handle sequence. At least two and up to one hundred thousand target specific amplicons are included in provided compositions. Provided compositions include highly multiplexed targeted libraries. In some embodiments, provided compositions comprise a plurality of nucleic acid amplicons, wherein each of the plurality of amplicons comprise a a 5' universal handle sequence, a first unique tag sequences, an intermediate target nucleic acid sequence, a second unique tag sequences and a 3' universal handle sequence. At least two and up to one hundred thousand target specific tagged amplicons are included in provided compositions. Provided compositions include highly multiplexed tagged targeted libraries.

In some embodiments, library compositions include a plurality of target specific amplicons comprising a multiplex of at least two different target nucleic acid sequences. In some embodiments, the composition comprises at least 25, 50, 75, 100, 150, 200, 250, 300, 350, 400, 450, 500, 750, 1000, 1250, 1500, 1750, 2000, 2250, 2500, 2750, 3000, 3250, 3500, 3750, 4000, 4500, 5000, 5500, 6000, 7000, 8000, 9000, 10000, 11000, or 12000, or more target-specific amplicons. In some embodiments, the target-specific amplicons comprise one or more exon, gene, exome or region of the genome associated with a clinical or pathological condition, e.g., amplicons comprising one or more sites comprising one or more mutations (e.g., driver mutation) associated with a cancer, e.g., lung, colon, breast cancer, etc., or amplicons comprising mutations associated with an inherited disease, e.g., cystic fibrosis, muscular dystrophies, etc. In some embodiments, the target-specific amplicons comprise a library of adaptor-ligated amplicon target sequences that are about 100 to about 750 base pairs in length.

As described herein, each of the plurality of amplicons comprises a 5' universal handle sequence. In some embodiments a universal handle sequence comprises any one or any combination of an amplification primer binding sequence, a sequencing primer binding sequence and/or a capture primer binding sequence. Preferably, the universal handle sequences of provided adaptors do not exhibit significant complementarity and/or hybridization to any portion of a unique tag sequence and/or target nucleic acid sequence of interest. In some embodiments a first universal handle sequence comprises any one or any combination of an amplification primer binding sequence, a sequencing primer binding sequence and/or a capture primer binding sequence. In some embodiments a second universal handle sequence comprises any one or any combination of an amplification primer binding sequence, a sequencing primer binding sequence and/or a capture primer binding sequence. In certain embodiments first and second universal handle sequences correspond to forward and reverse universal handle sequences and in certain embodiments the same first and second universal handle sequences are included for each of the plurality of target specific amplicons. Such forward and reverse universal handle sequences are targeted in conjunction with universal primers to carry out a second amplification of a preliminary library composition in production of resulting amplified according to methods of the invention. In certain embodiments a first 5' universal handle sequence comprises two universal handle sequences (e.g., a combination of an amplification primer binding sequence, a sequencing primer binding sequence and/or a capture primer binding sequence); and a second 5' universal sequence comprises two universal handle sequences (e.g., a combination of an amplification primer binding sequence, a sequencing primer binding sequence and/or a capture primer binding sequence), wherein the 5' first and second universal handle sequences do not exhibit significant hybridization to any portion of a target nucleic acid sequence of interest.

The structure and properties of universal amplification primers or universal primers are well known to those skilled in the art and can be implemented for utilization in conjunction with provided methods and compositions to adapt to specific analysis platforms. Universal handle sequences of the adaptors and amplicons provided herein are adapted accordingly to accommodate a preferred universal primer sequences. For example, e.g., as described herein universal P1 and A primers with optional barcode sequences have been described in the art and utilized for sequencing on Ion Torrent sequencing platforms (Ion Xpress™ Adapters, Thermo Fisher Scientific). Similarly, additional and other universal adaptor/primer sequences described and known in the art (e.g., Illumina universal adaptor/primer sequences can be found, e.g., at https://support.illumina.com/content/dam/illumina-support/documents/documentation/chemistry_documentation/experiment-design/illumina-adapter-sequences_1000000002694-01.pdf; PacBio universal adaptor/primer sequences, can be found, e.g., at https://s3.amazonaws.com/files.pacb.com/pdf/Guide_Pacific_Biosciences_Template_Preparation_and_Sequencing.pdf; etc.) can be used in conjunction with the methods and compositions provided herein. Suitable universal primers of appropriate nucleotide sequence for use with libraries of the invention are readily prepared using standard automated nucleic acid synthesis equipment and reagents in routine use in the art. One single type or separate types (or even a mixture) of two different universal primers, for example a pair of universal amplification primers suitable for amplification of a preliminary library may be used in production of the libraries of the invention. Universal primers optionally include a tag (barcode) sequence, where the tag (barcode) sequence does not hybridize to adaptor sequence or to target nucleic acid sequences. Barcode sequences incorporated into amplicons in a second universal amplification can be utilized e.g., for effective identification of sample source to thereby generate a barcoded library. Thus provided compositions include highly multiplexed barcoded targeted libraries. Provided compositions also include highly multiplexed barcoded tagged targeted libraries.

In some embodiments amplicon libraries comprise a unique tag sequence located between the 5' first universal handle sequence and the 3' target-specific sequence, and wherein the unique tag sequence does not exhibit significant complementarity and/or hybridization to any portion of a unique tag sequence and/or target nucleic acid sequence. In some embodiments the plurality of amplicons has $10^4$-$10^9$ different tag sequence combinations. Thus in certain embodiments each of the plurality of amplicons in a library comprises $10^4$-$10^9$ different tag sequences. In some embodiments each of the plurality of amplicons in a library comprises at least 1 different unique tag sequence and up to $10^5$ different unique tag sequences. In certain embodiments each target specific amplicon in a library comprises at least two and up to $10^9$ different combinations comprising different tag sequences, each having two different unique tag sequences. In some embodiments each of the plurality of amplicons in a library comprise a tag sequence comprising 4096 different tag sequences. In certain embodiments each target specific amplicon of a library comprises up to 16,777,216 different combinations comprising different tag sequences, each having two different unique tag sequences.

In some embodiments individual amplicons in the plurality of amplicons of a library include a unique tag sequence (e.g., contained in a tag adaptor sequence) comprising different random tag sequences alternating with fixed tag sequences. In some embodiments, the at least one unique tag sequence comprises a at least one random sequence and at least one fixed sequence, or comprises a random sequence flanked on both sides by a fixed sequence, or comprises a fixed sequence flanked on both sides by a random sequence. In some embodiments a unique tag sequence includes a fixed sequence that is 2-2000 nucleotides or base-pairs in length. In some embodiments a unique tag sequence includes a random sequence that is 2-2000 nucleotides or base-pairs in length.

In some embodiments, unique tag sequences include a sequence having at least one random sequence interspersed with fixed sequences. In some embodiments, individual tag sequences in a plurality of unique tags have the structure $(N)_n(X)_x(M)_m(Y)_y$, wherein "N" represents a random tag sequence that is generated from A, G, C, T, U or I, and wherein "n" is 2-10 which represents the nucleotide length of the "N" random tag sequence; wherein "X" represents a fixed tag sequence, and wherein "x" is 2-10 which represents the nucleotide length of the "X" random tag sequence; wherein "M" represents a random tag sequence that is generated from A, G, C, T, U or I, wherein the random tag sequence "M" differs or is the same as the random tag sequence "N", and wherein "m" is 2-10 which represents the nucleotide length of the "M" random tag sequence; and wherein "Y" represents a fixed tag sequence, wherein the fixed tag sequence of "Y" is the same or differs from the fixed tag sequence of "X", and wherein "y" is 2-10 which represents the nucleotide length of the "Y" random tag sequence. In some embodiments, the fixed tag sequence "X" is the same in a plurality of tags. In some embodiments, the fixed tag sequence "X" is different in a plurality of tags. In some embodiments, the fixed tag sequence "Y" is the same in a plurality of tags. In some embodiments, the fixed tag sequence "Y" is different in a plurality of tags. In some embodiments, the fixed tag sequences "$(X)_1$" and "$(Y)_y$" within the plurality of amplicons are sequence alignment anchors.

In some embodiments, the random sequence within a unique tag sequence is represented by "N", and the fixed sequence is represented by "X". Thus, a unique tag sequence is represented by $N_1N_2N_3X_1X_2X_3$ or by $N_1N_2N_3X_1X_2X_3N_4N_5N_6X_4X_5X_6$. Optionally, a unique tag sequence can have a random sequence in which some or all of the nucleotide positions are randomly selected from a group consisting of A, G, C, T, U and I. For example, a nucleotide for each position within a random sequence is independently selected from any one of A, G, C, T, U or I, or is selected from a subset of these six different types of nucleotides. Optionally, a nucleotide for each position within a random sequence is independently selected from any one of A, G, C or T. In some embodiments, the first fixed tag sequence "$X_1X_2X_3$" is the same or different sequence in a plurality of tags. In some embodiments, the second fixed tag sequence "$X_4X_5X_6$" is the same or different sequence in a plurality of tags. In some embodiments, the first fixed tag sequence "$X_1X_2X_3$" and the second fixed tag sequence "$X_4X_5X_6$" within the plurality of amplicons are sequence alignment anchors.

In some embodiments, a unique tag sequence comprises the sequence 5'-NNNACTNNNTGA-3', where "N" represents a position within the random sequence that is generated randomly from A, G, C or T, the number of possible distinct random tags is calculated to be $4^6$ (or 4^6) is about 4096, and the number of possible different combinations of two unique tags is $4^{12}$ (or 4^12) is about 16.78 million. In some embodiments, the underlined portions of 5'-NNNACT NNNTGA-3' are a sequence alignment anchor.

In some embodiments, the fixed sequences within the unique tag sequence is a sequence alignment anchor that can be used to generate error-corrected sequencing data. In some embodiments fixed sequences within the unique tag sequence is a sequence alignment anchor that can be used to generate a family of error-corrected sequencing reads.

Kits, Systems

Further provided herein are kits for use in preparing libraries of target nucleic acids using methods of the first or second aspects of the invention. Embodiments of a kit comprise a supply of at least a pair of target specific adaptors as defined herein which are capable of producing a first amplification product; as well as optionally a supply of at least one universal pair of amplification primers capable of annealing to the universal handle(s) of the adaptor and priming synthesis of an amplification product, which amplification product would include a target sequence of interest ligated to a universal sequence. Adaptors and/or primers may be supplied in kits ready for use, or more preferably as concentrates requiring dilution before use, or even in a lyophilized or dried form requiring reconstitution prior to use. In certain embodiments kits further include a supply of a suitable diluent for dilution or reconstitution of the components. Optionally, kits further comprise supplies of reagents, buffers, enzymes, dNTPs, etc., for use in carrying out amplification, digestion, repair, and/or purification in the generation of library as provided herein. Non-limiting examples of such reagents are as described in the Materials and Methods sections of the accompanying Exemplification. Further components which optionally are supplied in the kit include components suitable for purification of libraries prepared using the provided methods. In some embodiments, provided is a kit for generating a target-specific library comprising a plurality of target-specific adaptors having a 5' universal handle sequence, a 3' target specific sequence and a cleavable group, a DNA polymerase, an adaptor, dATP, dCTP, dGTP, dTTP, and a digestion reagent. In some embodiments, the kit further comprises one or more antibodies, a repair reagent, universal primers optionally comprising nucleic acid barcodes, purification solutions or columns.

Particular features of adaptors for inclusion in kits are as described elsewhere herein in relation to other aspects of the invention. The structure and properties of universal amplification primers are well known to those skilled in the art and can be implemented for utilization in conjunction with provided methods and compositions to adapt to specific analysis platforms (e.g., as described herein universal P1 and A primers have been described in the art and utilized for sequencing on Ion Torrent sequencing platforms). Similarly, additional and other universal adaptor/primer sequences described and known in the art (e.g., Illumina universal adaptor/primer sequences, PacBio universal adaptor/primer sequences, etc.) can be used in conjunction with the methods and compositions provided herein. Suitable primers of appropriate nucleotide sequence for use with adaptors included in the kit is readily prepared using standard automated nucleic acid synthesis equipment and reagents in routine use in the art. A kit may include a supply of one single type of universal primer or separate types (or even a mixture) of two different universal primers, for example a pair of amplification primers suitable for amplification of templates modified with adaptors in a first amplification. A kit may comprise at least a pair of adaptors for first amplification of a sample of interest according to the methods of the invention, plus at least two different amplification primers that optionally carry a different tag (barcode) sequence, where the tag (barcode) sequence does not hybridize to the adaptor. A kit can be used to amplify at least two different samples where each sample is amplified according to methods of the invention separately and a second amplification comprises using a single universal primer having a barcode, and then pooling prepared sample libraries after library preparations. In some embodiments a kit includes different universal primer-pairs for use in second amplification step described herein. In this context the 'universal' primer-pairs may be of substantially identical nucleotide sequence but differ with respect to some other feature or modification.

Further provided are systems, e.g., systems used to practice methods provided herein, and/or comprising compositions provided herein. In some embodiments, systems facilitate methods carried out in automated mode. In certain embodiments, systems facilitate high throughput mode. In certain embodiments, systems include, e.g., a fluid handling element, a fluid containing element, a heat source and/or heat sink for achieving and maintaining a desired reaction temperature, and/or a robotic element capable of moving components of the system from place to place as needed (e.g., a multiwell plate handling element).

Samples

As defined herein, "sample" and its derivatives, is used in its broadest sense and includes any specimen, culture and/or the like that is suspected of including a target nucleic acid. In some embodiments, a sample comprises DNA, RNA, TNA, chimeric nucleic acid, hybrid nucleic acid, multiplex-forms of nucleic acids or any combination of two or more of the foregoing. In some embodiments a sample useful in conjunction with methods of the invention includes any biological, clinical, surgical, agricultural, atmospheric or aquatic-based specimen containing one or more target nucleic acid of interest. In some embodiments, a sample includes nucleic acid molecules obtained from an animal such as a human or mammalian source. In another embodiment, a sample includes nucleic acid molecules obtained from a non-mammalian source such as a plant, bacteria, virus or fungus. In some embodiments, the source of the nucleic acid molecules may be an archived or extinct sample or species. In some embodiments a sample includes isolated nucleic acid sample prepared, for example, from a source such as genomic DNA, RNA TNA or a prepared sample such as, e.g., fresh-frozen or formalin-fixed paraffin-embedded (FFPE) nucleic acid specimen. It is also envisioned that a sample is from a single individual, a collection of nucleic acid samples from genetically related members, multiple nucleic acid samples from genetically unrelated members, multiple nucleic acid samples (matched) from a single individual such as a tumor sample and normal tissue sample, or genetic material from a single source that contains two distinct forms of genetic material such as maternal and fetal DNA obtained from a maternal subject, or the presence of contaminating bacteria DNA in a sample that contains plant or animal DNA. In some embodiments, a source of nucleic acid material includes nucleic acids obtained from a newborn (e.g., a blood sample for newborn screening). In some embodiments, provided methods comprise amplification of multiple target-specific sequences from a single nucleic acid sample. In some embodiments, provided methods comprise target-specific amplification of two or more target sequences from two or more nucleic acid samples or species. In certain embodiments, provided methods comprise amplification of highly multiplexed target nucleic acid sequences from a single sample. In particular embodiments, provided methods comprise amplification of highly multiplexed target nucleic acid sequences from more than one sample, each from the same source organism.

In some embodiments a sample comprises a mixture of target nucleic acids and non-target nucleic acids. In certain embodiments a sample comprises a plurality of initial polynucleotides which comprises a mixture of one or more target nucleic acids and may include one or more non-target nucleic acids. In some embodiments a sample comprising a plurality of polynucleotides comprises a portion or aliquot of an originating sample; in some embodiments, a sample comprises a plurality of polynucleotides which is the entire originating sample. In some embodiments a sample comprises a plurality of initial polynucleotides is isolated from the same source or from the same subject at different time points.

In some embodiments, a nucleic acid sample includes cell-free nucleic acids from a biological fluid, nucleic acids from a tissue, nucleic acids from a biopsied tissue, nucleic acids from a needle biopsy, nucleic acids from a single cell or nucleic acids from two or more cells. In certain embodiments, a single reaction mixture contains 1-100 ng of the plurality of initial polynucleotides. In some embodiments a plurality of initial polynucleotides comprises a formalin fixed paraffin-embedded (FFPE) sample; genomic DNA; RNA; TNA; cell free DNA or RNA or TNA; circulating tumor DNA or RNA or TNA; fresh frozen sample, or a mixture of two or more of the foregoing; and in some embodiments a the plurality of initial polynucleotides comprises a nucleic acid reference standard. In some embodiments, a sample includes nucleic acid molecules obtained from biopsies, tumors, scrapings, swabs, blood, mucus, urine, plasma, semen, hair, laser capture micro-dissections, surgical resections, and other clinical or laboratory obtained sample. In some embodiments, a sample is an epidemiological, agricultural, forensic or pathogenic sample. In certain embodiments, a sample includes a reference. In some embodiments a sample is a normal tissue or well documented tumor sample. In certain embodiments a reference is a standard nucleic acid sequence (e.g., Hg19).

Target Nucleic Acid Sequence Analysis

Provided methods and compositions of the invention are particularly suitable for amplifying, optionally tagging, and preparing target sequences for subsequent analysis. Thus, in some embodiments, methods provided herein include analyzing resulting library preparations. For example, methods comprise analysis of a polynucleotide sequence of a target nucleic acid, and, where applicable, analysis of any tag sequence(s) added to a target nucleic acid. In some embodiments wherein multiple target nucleic acid regions are amplified, provided methods include determining polynucleotide sequences of multiple target nucleic acids. Provided methods further optionally include using a second tag sequence(s), e.g., barcode sequence, to identify the source of the target sequence (or to provide other information about the sample source). In certain embodiments, use of prepared library composition is provided for analysis of the sequences of the nucleic acid library.

In particular embodiments, use of prepared tagged library compositions is provided for further analyzing the sequences of the target nucleic acid library. In some embodiments determination of sequences comprises determining the abundance of at least one of the target sequences in the sample. In some embodiments determination of a low frequency allele in a sample is comprised in determination of sequences of a nucleic acid library. In certain embodiments, determination of the presence of a mutant target nucleic acid in the plurality of polynucleotides is comprised in determination of sequences of a nucleic acid library. In some embodiments, determination of the presence of a mutant target nucleic acid comprises detecting the abundance level of at least one mutant target nucleic acid in the plurality of polynucleotides. For example, such determination comprises detecting at least one mutant target nucleic acid is present at 0.05% to 1% of the original plurality of polynucleotides in the sample, detecting at least one mutant target nucleic acid is present at about 1% to about 5% of the polynucleotides in the sample, and/or detecting at least 85%-100% of target nucleic acids in sample. In some embodiments, determination of the presence of a mutant target nucleic acid comprises detecting and identification of copy number variation and/or genetic fusion sequences in a sample.

In some embodiments, nucleic acid sequencing of the amplified target sequences produced by the teachings of this disclosure include de novo sequencing or targeted re-sequencing. In some embodiments, nucleic acid sequencing further includes comparing the nucleic acid sequencing results of the amplified target sequences against a reference nucleic acid sequence. In some embodiments, nucleic acid sequencing of the target library sequences further includes determining the presence or absence of a mutation within a nucleic acid sequence. In some embodiments, nucleic acid sequencing includes the identification of genetic markers associated with disease (e.g., cancer and/or inherited disease).

In some embodiments, prepared library of target sequences of the disclosed methods is used in various downstream analysis or assays with, or without, further purification or manipulation. In some embodiments analysis comprises sequencing by traditional sequencing reactions, high throughput next generation sequencing, targeted multiplex array sequence detection, or any combination of two or more of the foregoing. In certain embodiments analysis is carried out by high throughput next generation sequencing. In particular embodiments sequencing is carried out in a bidirectional manner, thereby generating sequence reads in both forward and reverse strands for any given amplicon.

In some embodiments, library prepared according to the methods provided herein is then further manipulated for additional analysis. For example, \ prepared library sequences is used in downstream enrichment techniques known in the art, such a bridge amplification or emPCR to generate a template library that is then used in next generation sequencing. In some embodiments, the target nucleic acid library is used in an enrichment application and a sequencing application. For example, sequence determination of a provided target nucleic acid library is accomplished using any suitable DNA sequencing platform. In some embodiments, the library sequences of the disclosed methods or subsequently prepared template libraries is used for single nucleotide polymorphism (SNP) analysis, genotyping or epigenetic analysis, copy number variation analysis, gene expression analysis, analysis of gene mutations including but not limited to detection, prognosis and/or diagnosis, detection and analysis of rare or low frequency allele mutations, nucleic acid sequencing including but not limited to de novo sequencing, targeted resequencing and synthetic assembly analysis. In one embodiment, prepared library sequences are used to detect mutations at less than 5% allele frequency. In some embodiments, the methods disclosed herein is used to detect mutations in a population of nucleic acids at less than 4%, 3%, 2% or at about 1% allele frequency. In another embodiment, libraries prepared as described herein are sequenced to detect and/or identify germline or somatic mutations from a population of nucleic acid molecules. In certain embodiments, sequencing adaptors are ligated to the ends of the prepared libraries generate a plurality of libraries suitable for nucleic acid sequencing.

In some embodiments, methods for preparing a target-specific amplicon library are provided for use in a variety of downstream processes or assays such as nucleic acid sequencing or clonal amplification. In some embodiments, the library is amplified using bridge amplification or emPCR to generate a plurality of clonal templates suitable for nucleic acid sequencing. For example, optionally following target-specific amplification a secondary and/or tertiary amplification process including, but not limited to, a library amplification step and/or a clonal amplification step is performed. "Clonal amplification" refers to the generation of many copies of an individual molecule. Various methods known in the art is used for clonal amplification. For example, emulsion PCR is one method, and involves isolating individual DNA molecules along with primer-coated beads in aqueous bubbles within an oil phase. A polymerase chain reaction (PCR) then coats each bead with clonal copies of the isolated library molecule and these beads are subsequently immobilized for later sequencing. Emulsion PCR is used in the methods published by Marguilis et al. and Shendure and Porreca et al. (also known as "polony sequencing", commercialized by Agencourt and recently acquired by Applied Biosystems). Margulies, et al. (2005) *Nature* 437: 376-380; Shendure et al., *Science* 309 (5741): 1728-1732. Another method for clonal amplification is "bridge PCR," where fragments are amplified upon primers attached to a solid surface. These methods, as well as other methods of clonal amplification, both produce many physically isolated locations that each contain many copies derived from a single molecule polynucleotide fragment. Thus, in some embodiments, the one or more target specific amplicons are amplified using for example, bridge amplification or emPCR to generate a plurality of clonal templates suitable for nucleic acid sequencing.

In some embodiments, at least one of the library sequences to be clonally amplified are attached to a support or particle. A support can be comprised of any suitable material and have any suitable shape, including, for example, planar, spheroid or particulate. In some embodiments, the support is a scaffolded polymer particle as described in U.S. Published App. No. 20100304982, hereby incorporated by reference in its entirety. In certain embodiments methods comprise depositing at least a portion of an enriched population of library sequences onto a support (e.g., a sequencing support), wherein the support comprises an array of sequencing reaction sites. In some embodiments, an enriched population of library sequences are attached to the sequencing reaction sites on the support wherein the support comprises an array of $10^2$-$10^{10}$ sequencing reaction sites.

Sequence determination means determination of information relating to the sequence of a nucleic acid and may include identification or determination of partial as well as full sequence information of the nucleic acid. Sequence information may be determined with varying degrees of statistical reliability or confidence. In some embodiments sequence analysis includes high throughput, low depth detection such as by qPCR, rtPCR, and/or array hybridization detection methodologies known in the art. In some embodiments, sequencing analysis includes the determination of the in depth sequence assessment, such as by Sanger sequencing or other high throughput next generation sequencing methods. Next-generation sequencing means sequence determination using methods that determine many (typically thousands to billions) nucleic acid sequences in an intrinsically massively parallel manner, e.g. where many sequences are read out, e.g., in parallel, or alternatively using an ultra-high throughput serial process that itself may be parallelized. Thus, in certain embodiments, methods of the invention include sequencing analysis comprising massively parallel sequencing. Such methods include but are not limited to pyrosequencing (for example, as commercialized by 454 Life Sciences, Inc., Branford, Conn.); sequencing by ligation (for example, as commercialized in the SOLiD™. technology, Life Technologies, Inc., Carlsbad, Calif.);

sequencing by synthesis using modified nucleotides (such as commercialized in TruSeq™ and HiSeg™ and MiSeq™ and/or NovaSeq™ technology by Illumina, Inc., San Diego, Calif.; HeliScope by Helicos Biosciences Corporation, Cambridge, Mass.; and PacBio Sequel® or RS systems by Pacific Biosciences of California, Inc., Menlo Park, Calif.), sequencing by ion detection technologies (e.g., Ion Torrent™ technology, Life Technologies, Carlsbad, Calif.); sequencing of DNA nanoballs (Complete Genomics, Inc., Mountain View, Calif.); nanopore-based sequencing technologies (for example, as developed by Oxford Nanopore Technologies, LTD, Oxford, UK), and like highly parallelized sequencing methods.

For example, in certain embodiments, libraries produced by the teachings of the present disclosure are sufficient in yield to be used in a variety of downstream applications including the Ion Xpress™ Template Kit using an Ion Torrent™ PGM system (e.g., PCR-mediated addition of the nucleic acid fragment library onto Ion Sphere™ Particles) (Life Technologies, Part No. 4467389) or Ion Torrent Proton™ system). For example, instructions to prepare a template library from the amplicon library can be found in the Ion Xpress Template Kit User Guide (Life Technologies, Part No. 4465884), hereby incorporated by reference in its entirety. Instructions for loading the subsequent template library onto the Ion Torrent™ Chip for nucleic acid sequencing are described in the Ion Sequencing User Guide (Part No. 4467391), hereby incorporated by reference in its entirety.

The initiation point for the sequencing reaction may be provided by annealing a sequencing primer to a product of a solid-phase amplification reaction. In this regard, one or both of the adaptors added during formation of template library may include a nucleotide sequence which permits annealing of a sequencing primer to amplified products derived by whole genome or solid-phase amplification of the template library. Depending on implementation of an embodiment of the invention, a tag sequence and/or target nucleic acid sequence may be determined in a single read from a single sequencing primer, or in multiple reads from two different sequencing primers. In the case of two reads from two sequencing primers, a 'tag read' and a 'target sequence read' are performed in either order, with a suitable denaturing step to remove an annealed primer after the first sequencing read is completed.

In some embodiments, a sequencer is coupled to server that applies parameters or software to determine the sequence of the amplified target nucleic acid molecules. In certain embodiments, the sequencer is coupled to a server that applies parameters or software to determine the presence of a low frequency mutation allele present in a sample.

EXEMPLIFICATION

Example 1

Materials and Methods

Reverse Transcription (RT) Reaction method (21 uL reaction) may be carried out in samples where RNA and DNA are analyzed, e.g., FFPE RNA and cfTNA:
1. Thaw the 5×URT buffer at room temperature for at least 5 minutes. (NOTE: Check for white precipitate in the tube. Vortex to mix as needed)

| URT Buffer | 5x concentration |
|---|---|
| TrisHCl ph8.4 | 125 mM |
| Ammonium sulfate | 50 mM |
| MgCl2 | 20 mM |
| dNTP pH7.6 | 5 mM |

2. In a MicroAmp EnduraPlate 96-well plate, set up the RT reaction by adding the following components. (5-15 ng RNA or DNA//5-40 ng cfTNA)

| Component | Volume |
|---|---|
| 20 ng input cfTNA/10 ng FFPE RNA | 15 μL |
| 5x URT buffer | 4 μL |
| 10x RT (SSIV) Enzyme Mix | 2 μL |
| Total volume | 21 L |

3. Mix entire contents by vortexing or pipetting. Spin down briefly.
4. Add 20 μl Parol 40 C oil to the top of each reaction mix.
5. Load the plate into thermocycler (e.g., SimpliAmp Thermocycler), and run the following program:

| Stage | Temperature | Time |
|---|---|---|
| Stage 1 | 25° C. | 10 min |
| Stage 2 | 50° C. | 10 min |
| Stage 3 | 85° C. | 5 min |
| Hold | 4° C. | ∞ |

Low-Cycle Tagging PCR (38 uL reaction volume+20 uL oil):
Assemble tagging PCR reaction in 96-well PCR plate wells: FFPE DNA Samples Only
1. Assemble the reaction by adding the following components to a MicroAmp EnduraPlate 96-well plate:
   a. Prepare UDG mix: 1 ul+5 ul 5×URT buffer
   b. Add the 6 ul diluted UDG to 15 μl FFPE DNA samples.
   c. Mix by vortexing. Briefly spin down to collect reaction at the bottom of the wells.
   d. Add 20 μL Parol 40 C Oil to the top of each sample.
   e. Perform the reaction as following:

| Stage | Temperature | Time |
|---|---|---|
| Stage 1 | 37° C. | 2 min |
| Stage 2 | 50° C. | 10 min |
| Hold | 4° C. | >=1 min |

2. Prepare Amplification Master Mix:

| Component | Volume |
|---|---|
| Hawkeye panel FWD pool (125 nM) | 3.75 μL |
| Hawkeye panel REV pool (125 nM) | 3.75 μL |
| 4xSuperFiU MM v2.0 | 9.5 μL |
| Total volume | 17 μL |

3. Add 17 μL PCR Master Mix to 21 μL UDG treated FFPE DNA samples.

Set a pipette at 20 μL volume. Mix the reaction below oil by pipetting up and down 20 times to ensure thorough mix of the reaction without disturbing the oil phase. Spin down the plate briefly.

FFPE RNA and cfTNA Samples Only

1. Add components directly to the RT reactions from RT steps above:

| Component | Volume |
| --- | --- |
| RT reaction | 21 μL |
| Hawkeye panel FWD pool (10x, 125 nM) | 3.8 μL |
| Hawkeye panel REV pool (10x, 125 nM) | 3.8 μL |
| 4xSuperFiU MM v2.0 | 9.5 μL |
| Total volume | 38 L |

2. Set a pipette at 20 μL volume. Mix the reaction below oil by pipetting up and down 20 times to ensure thorough mix of the reaction without disturbing the oil phase. Spin down the plate briefly.
3. Perform 3-cycles tagging PCR using the following cycling condition on SimpliAmp:

For FFPF DNA and RNA Libraries:

| Stage | Temperature | Time |
| --- | --- | --- |
| Hold | 99° C. | 1 min |
| Cycle: 3 | 99° C. | 30 sec |
|  | 64° C. | 2 min |
|  | 60° C. | 12 min |
|  | 66° C. | 2 min |
|  | 72° C. | 2 min |
| Hold | 72° C. | 2 min |
| Hold | 4° C. | ∞ |

For cfTNA Libraries.

| Stage | Temperature | Time |
| --- | --- | --- |
| Cycle: 3 | 99° C. | 30 sec |
|  | 64° C. | 2 min |
|  | 60° C. | 12 min |
|  | 66° C. | 2 min |
|  | 72° C. | 2 min |
| Hold | 72° C. | 2 min |
| Hold | 4° C. | ∞ |

Digestion-Filling-Ligation (45.6 μL reaction volume+20 μL oil):

1. Add 7.6 μL of SUPA into each of the above PCR reaction well. Add SUPA directly to the sample below the oil layer.
2. Set a pipette at 25 μL. Mix the reaction below oil layer by pipetting up and down for 20 times. Spin down the plate briefly.
3. Load the plate into thermocycler and run the following program:

| Stage | Temperature | Time |
| --- | --- | --- |
| Stage 1 | 30° C. | 15 min |
| Stage 2 | 50° C. | 15 min |
| Stage 3 | 55° C. | 15 min |
| Stage 4 | 25° C. | 10 min |
| Stage 5 | 98° C. | 2 min |
| Hold | 4° C. | ∞ |

Library Amplification (~51 μL reaction volume+20 μL Oil)

1. Carefully transfer 30 μL the above post digestion-filling-ligation reaction to AmpliSeq HD Dual Barcodes. Mix well by pipetting up and down 20 times. Transfer all the reactions back to the original well under the oil layer.
2. Set a pipette at 30 μL. Mix entire reaction below oil by pipetting up and down 20 times. Spin down the plate briefly.
3. Load the plate into thermocycler and run the following program:

| Stage | Temperature | Time |
| --- | --- | --- |
| Hold | 99° C. | 15 sec |
| Cycle: 5 | 99° C. | 15 sec |
|  | 62° C. | 20 sec |
|  | 72° C. | 20 sec |
| Cycle: 15 (FFPE DNA and cfTNA) | 99° C. | 15 sec |
| Cycle: 18 (FFPE RNA) | 70° C. | 40 sec |
| Hold | 72° C. | 5 min |
| Hold | 4° C. | ∞ |

2-Round AmpureXP Library Purification

Resulting repaired sample is purified using 36.8 ul Ampure® beads (Beckman Coulter, Inc.) according to the manufacturer instructions for two rounds. Briefly:

Transfer 46 μL of library reaction below oil layer to new, clean wells on the PCR plate.

Add 36.8 μl of Agencourt™ AMPure™ XP Reagent to each sample and mix by pipetting then incubate at room temperature for 5 minutes.

Place the plate on magnet until the solutions in wells become clear.

Carefully remove the supernatant; then remove residual supernatant.

Add 150 uL of 80% ethanol in 10 mM pH 8 Tris-HCl. Do not disturb the bead pellet.

Toggle plate on magnet 3 times with 5 seconds interval; Remove the supernatant; Repeat wash steps one more time. Use a pipette to remove residual buffer in the wells.

Dry wells at room temperature for 5 min.

Add 30 uL of low TE buffer to the wells and pipette to resuspend beads.

Incubate the solution at room temperature for 5 min, Place plate on magnet to clear solution.

Transfer 30 uL of the eluent into clean well on a plate.

Add into the above well 30 μL (1× Volume) of AmpureXP beads; Pipette in well to mix.

Repeat steps as above, using 40 uL of low TE buffer to elute after second purification.

Transfer 40 uL of the library into a new clean well.

Library Normalization with Individual Equalizer

First, warm all reagents in the Ion Library Equalizer™ Kit to room temperature. Vortex and centrifuge all reagents. Wash the Equalizer™ Beads (if previously performed skip to Add Equalizer™ Beads and Wash).

1. For each 4 reaction, add 12 μL of beads into a clean 1.5-mL tube and 24 μL/reaction Equalizer™ Wash Buffer.
2. Place tube in a magnetic rack for 3 minutes or until the solution is completely clear.
3. Carefully remove and discard the supernatant without disturbing the pellet.
4. Remove from magnet, add 24 μL per reaction Equalizer™ Wash Buffer, and resuspend.

Amplify the Library

5. Remove plate with purified libraries from the magnet, then add 10 μL of 5×DV-Amp Mix and 2 μL of Equalizer™ Primers (pink cap in Equalizer kit). Total volume=52 μL
6. Mix.
7. Add 20 μL Parol 40 C Oil gently on top of samples.
8. run the following program on thermocycler:
    98 C for 2 min
    9-cycles amplification for FFPE DNA/RNA OR 6-cycles amplification for cfTNA:
    98 C for 15 sec
    64 C for 1 min
    Then
    Hold at 4 C for infinite
9. (Optional) after thermal cycling, centrifuge plate to collect any droplets.

Add Equalizer™ Capture to the Amplified Library

10. Add 10 μL of Equalizer Capture to each library amplification reaction beneath the oil layer.
11. mix up and down 10×.
12. Incubate at room temperature for 5 minutes.

Add Equalizer™ Beads and Wash

13. Transfer 60 μL amplified library samples beneath the oil layer into well with washed beads.
14. mix thoroughly.
15. Incubate at room temperature for 5 minutes.
16. Place plate in magnet, then incubate for 2 minutes or until the solution is clear.
17. remove the supernatant.
18. Add 150 μL of Equalizer™ Wash Buffer to each reaction.
19. With the plate still in the magnet, remove, and discard supernatant.
20. Repeat the bead wash Elute the Equalized Library.

Elute the Equalized Library

21. Remove plate from magnet, add 100 μL of Equalizer™ Elution Buffer to each pellet.
22. Pipette mix with 50 ul volume 5×.
23. Elute library by incubating on thermo cycler at 32° C. for 5 minutes.
24. Remove immediately, place plate in magnet, as soon as solution is clear, move to new wells.
25. Perform qPCR and adjust pool @100 pM for templating and sequencing.

Example 2

Compositions and Methods

The first step of provided methods comprises a few rounds of amplification, for example, three to six cycles of amplification, and in certain instances, three cycles of amplification using forward and reverse adaptors to each gene specific target sequence. Each adaptor contains a 5'universal sequence, and a 3' gene specific target sequence. In some embodiments adaptors optionally comprise a unique tag sequence located between the 5' universal and the 3' gene specific target sequences.

In specific embodiments wherein unique tag sequences are utilized, each gene specific target adaptor pair includes a multitude of different unique tag sequences in each adaptor. For example, each gene specific target adaptor comprises up to 4096 TAGS. Thus, each target specific adaptor pair comprises at least four and up to 16,777,216 possible combinations.

Each of the provided adaptors comprises a cleavable uracil in place of thymine at specific locations in the forward and reverse adaptor sequences. Positions of uracils (Us) are consistent for all forward and reverse adaptors having unique tag sequences, wherein uracils (Us) are present flanking the 5' and 3' ends of the unique tag sequence when present; and Us are present in each of the gene specific target sequence regions, though locations for each gene specific target sequence will inevitably vary. Uracils flanking each unique tag sequence (UT) and in gene-specific sequence regions are designed in conjunction with sequences and calculated Tm of such sequences, to promote fragment dissociation at a temperature lower than melting temperature of the universal handle sequences, which are designed to remain hybridized at a selected temperature. Variations in Us in the flanking sequences of the UT region are possible, however designs keep the melting temperature below that of the universal handle sequences on each of the forward and reverse adaptors. Exemplary adaptor sequence structures comprise:

```
Forward Adaptor:
------A Handle----- ------*UT*------ --Gene Specific--
                                          SEQ ID NO: 1564
TCTGTACGGTGACAAGGCG-U-NNNACTNNNTGA-U-XXXXXXXXXXXXXXXX Reverse Adaptor
                                          SEQ ID NO: 1565
TGACAAGGCGTAGTCACGG-U-NNNACTNNNTGA-U-XXXXXXXXXXXXXXXX
-----B Handle------- ------UT------- -------Gene Specific-------
```

Wherein each N is a base selected from A, C, G, or T and the constant sections of the UT region are used as anchor sequences to ensure correct identification of variable (N) portion. The constant and variable regions of the UT can be significantly modified (e.g., alternative constant sequence, >3 Ns per section) as long as the Tm of the UT region remains below that of the universal handle regions. Importantly, cleavable uracils are absent from each forward (e.g., TCTGTACGGTGACAAGGCG (SEQ ID NO:1566 and reverse (e.g., TGACAAGGCGTAGTCACGG (SEQ ID NO:1567) universal handle sequence. In the present example, universal sequences have been designed to accommodate follow on amplification and addition of sequencing sequences on the ION Torrent platform, however, one skilled in the art would understand that such universal sequences could be adaptable to use other universal sequences which may be more amenable to alternative sequencing platforms (e.g., ILLUMINA sequencing systems, QIAGEN sequencing systems, PACBIO sequencing systems, BGI sequencing systems, or others).

Methods of use of provided compositions comprise library preparation via AmpliSeq HD technology with slight variations thereof and using reagents and kits available from Thermo Fisher Scientific. SuperFiU DNA comprises a modification in the uracil-binding pocket (e.g., AA 36) and a family B polymerase catalytic domain (e.g., AA 762). SuperFiU is described in U.S. Provisional patent application No. 62/524,730 filed Jun. 26, 2017, which is hereby incorporated by reference. Polymerase enzymes may be limited in their ability to utilize uracil and/or any alternative cleavable residues (e.g., inosine, etc.) included into adaptor sequences. In certain embodiments, it may also be advantageous to use a mixture of polymerases to reduce enzyme specific PCR errors.

The second step of methods involves partial digestion of resulting amplicons, as well as any unused uracil-containing adaptors. For example, where uracil is incorporated as a cleavable site, digestion and repair includes enzymatic cleavage of the uridine monophosphate from resulting primers, primer dimers and amplicons, and melting DNA fragments, then repairing gapped amplicons by polymerase fill-in and ligation. This step reduces and potentially eliminates primer-dimer products that occur in multiplex PCR. In some instances, digestion and repair are carried out in a single step. In certain instances, it may be desirable to separate digestion and repair-steps temporally. For example, thermolabile polymerase inhibitors may be utilized in conjunction with methods, such that digestion occurs at lower temperatures (25-40° C.), then repair is activated by increasing temperature enough to disrupt a polymerase-inhibitor interaction (e.g., polymerase-Ab), though not high enough to melt the universal handle sequences.

Uracil-DNA Glycosylase (UDG) enzyme can be used to remove uracils, leaving abasic sites which can be acted upon by several enzymes or enzyme combinations including (but not limited to): APE 1-Apurinic/apyrimidinic endonuclease; FPG-Formamidopyrimidine [fapy]-DNA glycosylase; Nth-Endonuclease III; Endo VIII-Endonuclease VIII; PNK-Polynucleotide Kinase; Taq-Thermus aquaticus DNA polymerase; DNA pol I-DNA polymerase I; Pol beta-Human DNA polymerase beta. In a particular implementation, the method uses Human apurinic/apyrimidinic endonuclease, APE1. APE1 activity leaves a 3'-OH and a 5'deoxyribose-phosphate (5'-dRP). Removal of the 5'-dRP can be accomplished by a number of enzymes including recJ, Polymerase beta, Taq, DNA pol I, or any DNA polymerase with 5'-3' exonuclease activity. Removal of the 5'-dRP by any of these enzymes creates a ligatable 5'-phosphate end. In another implementations, UDG activity removes the Uracil and leaves and abasic site which is removed by FPG, leaving a 3' and 5'-phosphate. The 3'-phosphate is then removed by T4 PNK, leaving a polymerase extendable 3'-OH. The 5'-deoxyribose phosphate can then be removed by Polymerase beta, fpg, Nth, Endo VIII, Taq, DNA pol I, or any other DNA polymerase with 5'-3' exonuclease activity. In a particular implementation Taq DNA polymerase is utilized.

Repair fill-in process can be accomplished by almost any polymerase, possibly the amplification polymerase used for amplification in step 1 or by any polymerase added in step 2 including (but not limited to): Phusion DNA polymerase; Phusion U DNA polymerase; SuperFi DNA polymerase; SuperFi U DNA polymerase; TAQ; Pol beta; T4 DNA polymerase; and T7 DNA polymerase. Ligation repair of amplicons can be performed by many ligases including (but not limited to): T4 DNA ligase; T7 DNA ligase; Taq DNA ligase. In a particular implementation of the methods, Taq DNA polymerase is utilized and ligation repaired in accomplished by T7 DNA ligase.

A last step of library preparation involves amplification of the repaired amplicons by standard PCR protocols using universal primers that contain sequences complementary to the universal handle sequences on the 5' and 3' ends of prepared amplicons. For example, an A-universal primer, and a P1 universal primer, each part of the Ion Express Adaptor Kit (Thermo Fisher Scientific, Inc.) may optionally contain a sample specific barcode. The last library amplification step may be performed by many polymerases including, but not limited to: Phusion DNA polymerase; Phusion U DNA polymerase; SuperFi DNA polymerase; SuperFi U DNA polymerase; Taq DNA polymerase; Veraseq Ultra DNA polymerase.

Example 3

Assay Content and Methods

With primers directed to target sequences specific to targets in Table 1, adaptors each comprise 4096 unique tag sequences for each gene specific target sequence, resulting in an estimate of 16,777,216 different unique tag combinations for each gene specific target sequence pair.

Preparation of library was carried out according to the method described above. Prepared libraries are prepared for templating and sequenced, and analyzed. Sequencing can be carried out by a variety of known methods, including, but not limited to sequencing by synthesis, sequencing by ligation, and/or sequencing by hybridization. Sequencing has been carried out in the examples herein using the Ion Torrent platform (Thermo Fisher Scientific, Inc.), however, libraries can be prepared and adapted for analysis, e.g., sequencing, using any other platforms, e.g., Illumina, Qiagen, PacBio, etc. Results may be analyzed using a number of metrics to assess performance, for example:

# of families (with ng input DNA captured) The median # of families is a measure of the number of families that maps to an individual target. In this case, each unique molecular tag is a family.

Uniformity is a measure of the percentage of target bases covered by at least 0.2× the average read depth. This metric is used to ensure that the technology does not selectively under-amplify certain targets.

Positives/Negatives: When a control sample with known mutations is utilized is analyzed (e.g., Acrometrix Oncology Hotspot Control DNA, Thermo Fisher Scientific, Inc.), the number of True Positives can be tracked.

True Positives: The number of True Positives informs on the number of mutations that were present and correctly identified.

False positives (FP): (Hot spot and Whole Target) The number of False Positives informs on the number of mutations that are determined to be present, but known not to be in the sample.

False negatives (FN) (if acrometrix spike-in is used) The number of False Negatives informs on the number of mutations that were present but not identified.

On/Off Target is the percentage of mapped reads that were aligned/not aligned over a target region. This metric is used to ensure the technology amplifies predominantly the targets to which the panel was designed.

Low quality is tracked to ensure the data is worth analyzing. This metric is a general system metric and isn't directly related to this technology.

TABLE 1

Precision Assay Gene Content by Variant Class

| DNA Hotspots | CNV | Inter-Genetic Fusions | Intra-Genetic Fusions |
|---|---|---|---|
| AKT1 | GNAS | ALK | ALK |
| AKT2 | HRAS | AR | BRAF |
| AKT3 | IDH1 | CD274 | ESR1 |
| ALK | IDH2 | CDKN2A | FGFR1 |
| AR | KIT | EGFR | FGFR2 |
| ARAF | KRAS | ERBB2 | FGFR3 |
| BRAF | MAP2K1 | ERBB3 | MET |
| CDK4 | MAP2K2 | FGFR1 | NRG1 |
| CDKN2A | MET | FGFR2 | NTRK1 |
| CHEK2 | MTOR | FGFR3 | NTRK2 |
| CTNNB1 | NRAS | KRAS | NTRK3 |
| EGFR | NTRK1 | MET | NUTM1 |
| ERBB2 | NTRK2 | PIK3CA | RET |
| ERBB3 | NTRK3 | PTEN | ROS1 |
| ERBB4 | PDGFRA | | RSPO2 |
| ESR1 | PIK3CA | | RSPO3 |
| FGFR1 | PTEN | | |
| FGFR2 | RAF1 | | |
| FGFR3 | RET | | |
| FGFR4 | ROS1 | | |
| FLT3 | SMO | | |
| GNA11 | TP53 | | |
| GNAQ | | | |

Bold includes non-targeted fusion
50 Total Genes
45 DNA Hotspot Genes
14 CNV Genes
16 Inter-Genetic Fusions
3 Intra-Genetic Fusions Clinical evidence is defined as number of instances that a gene/variant combination appears in drug labels, guidelines, and/or clinical trials. Tables 2 and 3 depict top genes/variants and indications relevant to provided assay, as supported by clinical evidence.

TABLE 2

Top 5 assay genes/variant types
with the most clinical evidence

ERBB2 (HER2) amplification
EGFR hotspot mutations
BRAF hotspot mutations
KRAS hotspot mutations
ALK fusions

TABLE 3

Top 5 indications
with the most clinical evidence

NSCLC
Breast
Colorectal
Melanoma
Kidney

Up to 29 gene and variant combinations covered under the provided assay are on drug labels and/or guidelines (NCCN and ESMO)

TABLE 4

Cancer Indications Ranked by Clinical Evidence

| | | |
|---|---|---|
| Non-Small Cell Lung Cancer | Ovarian Cancer | Thyroid Cancer |
| Unspecified Solid Tumor | Bladder Cancer | Glioblastoma |
| Breast Cancer | Esophageal Cancer | Soft Tissue Sarcoma |
| Colorectal Cancer | Head and Neck Cancer | Gastrointestinal Stromal Tumor |
| Melanoma | Endometrial Cancer | Small Cell Lung Cancer |
| Kidney Cancer | Pancreatic Cancer | Cervical Cancer |
| Gastric Cancer | Liver Cancer | |

Example 4

Results

Primers were designed using the composition design approach provided herein and targeted to oncology genes using those of the panel target genes as described above in Table 1, where the library amplification step utilized two primer pairs (to put the two universal sequences on each end of amplicons, e.g., an A-universal handle and a P1-universal handle on each end) to enable bidirectional sequencing as described herein. Prepared library was sequenced using Ion Gene Studio Templating/and Sequencing kits and instrumentation (Thermo Fisher Scientific, Inc.) and/or a new fully integrated library preparation, templating and sequencing system. Performance with the instant panel indicates the technology is able to appropriately detect targeted mutations, copy number variations and fusions as intended.

4A. Fusion Detection Capability in Various ALK and ROS Isoforms from NSCLC FFPE Samples Libraries were prepared and sequenced as described above. Various fusion isoform detection was demonstrated as expected:

| HIP1-ALK.H21A20 | KIF5B-ALK.K17A20 | EML4-ALK.E20A20 |
|---|---|---|
| Read Count: 373 | Read Count: 602 | Read Count: 671 |
| Molecular Count: 3 | Molecular Count: 10 | Molecular Count: 12 |

| CD74-ROS1. C6R34. | SLC34A2-ROS1.S13R32 |
|---|---|
| Read Count: 1947 | Read Count: 2518 |
| Molecular Count: 82 | Molecular Count: 82 |

4B: Mutation Detection in Matched Samples With GeneStudio S5 and New Sequencer

| Sample | GeneStudio S5 | | NEW System | |
|---|---|---|---|---|
| Type | FFPE | Plasma | FFPE | Plasma |
| Breast | ✓ PIK3CA G1049R | ✓ PIK3CA G1049R | ✓ PIK3CA G1049R | ✓ PIK3CA G1049R |
| Colon | ✓ None | ✓ None | ✓ None | ✓ None |
| Colon | ✓ KRAS G12V | ✓ KRAS G12V | ✓ KRAS G12V | ✓ KRAS G12V |
| Colon | ✓ KRAS G12D | ✓ KRAS G12D | ✓ KRAS G12D | ✓ KRAS G12D |
| NSCLC | ✓ KRAS Q61H | ✓ KRAS Q61H | ✓ KRAS Q61H | ✓ KRAS Q61H |

Library preparation, sequencing and analysis was carried out for mutation detection in matched samples as described above using both manual preparation and sequencing on ION GeneStudio S5 as well as an automated and integrated library preparation, templating and sequencing system. The precision assay demonstrated concordant PIK3CA and KRAS mutation detection across matched tissue and plasma samples with both the GeneStudio S5 with manual workflow as compared to the automated system.

4C: DNA Variant Detection Across Various Cancer Indications

Library preparation, sequencing and analysis was carried out for mutation detection in a variety of different sample types as described above using both manual preparation and sequencing on ION GeneStudio S5 as well as an automated and integrated library preparation, templating and sequencing system. The precision assay demonstrated detected various driver mutations across different cancer indication sample types.

| Melanoma | Breast | Colon | Squamous Cell Carcinoma (SCC) | Pancreas | Glioblastoma | Solid Tumor | NSCLC |
|---|---|---|---|---|---|---|---|
| NRAS | NRAS | EGFR | KRAS | KRAS | EGFR | NTRK | EGFR |
| BRAF | BRAF | BRAF | TP53 | | Amplification | fusions | BRAF |
| KIT | PIK3CA | KRAS | | | | | KRAS |
| | ERBB2 | NRAS | | | | | ERBB2 |
| | amplification | | | | | | MET |
| | | | | | | | ALK fusions |
| | | | | | | | ROS fusions |
| | | | | | | | RET fusions |

4D: Detection Using Cohort of Matched FFPE and Plasma Samples

Library preparation, sequencing and analysis was carried out for evaluation of performance of the assay in detecting variants across cohort of matched FFPE and plasma samples. The assay demonstrated detection of various driver mutations across different cancer indication sample types. Using the assay on a set of matched FFPE and plasma samples, 4 out of 8 had concordant PIK3CA(1) and KRAS (3) mutations; while 1 out of 8 had concordant NO variants detected

| Sample # | Cancer Type | Tumor Grade | Stage | FFPE Variant Results | Plasma Variant Results |
|---|---|---|---|---|---|
| 1 | Breast | G2 | IIIA | PIK3CA G1049R (32.26%) | PIK3CA G1049R (12.88%) |
| 2 | Breast | G3 | IIIA | FGFR1 CNV (7.2) | TBD* |
| 3 | Breast | G3 | IIIC | TP53 H179R (68.42%) ERBB2 CNV (16.2) | None TBD* |
| 4 | Colon | G2 | IIIA | None | None |
| 5 | Colon | G3 | IIIA | KRAS G12V (41.35%) PTEN 1.14 | KRAS G12V (12.81%) TBD* |
| 6 | Colon | G2 | IIIA | KRAS G12D (11.29%) | KRAS G12D (15.42%) |
| 7 | NSCLC | Unknown | IIIB | KRAS G12D (12.24%) | None |
| 8 | NSCLC | Unknown | IIIA | KRAS Q61H (26.41%) | KRAS Q61H (1.67%) |

4E: Detection of Variants in FFPE Cancer Samples with Known Variants

Library preparation, sequencing and analysis was carried out for evaluation of performance of the assay in detecting variants in 16 FFPE samples (NSCLC, Breast, and CRC) with known mutations previously confirmed using ONCOMINE cfDNA assays. Samples were tested within a single run (chip) using the assay on an integrated system. 8 samples had previously been characterized using Oncomine cfDNA assays In this cohort, 17 mutations were detected by the present assay, within EGFR, ERBB4, IDH1, KRAS, MET, PIK3CA, and TP53 Additionally, 3 amplifications in EGFR, ERBB2, and FGFR1 were detected Lastly, 3 fusions with FGFR2 and RSPO3 driver genes were also detected. The assay was able to detect a number of variants, including SNV mutations, CNV amplifications, and fusions in a cohort of FFPE samples.

4F: SNV and CNV Detection with Multiple Cancer Type from FFPE

The assay was used to detect various driver mutations across different cancer indications. All results were concordant with previous characterization using different assay and system:

| Pathological diagnosis | Sample ID FFPE | Previous SNV | Previous SNV AF | Allele freq. FFPE family-based | Allele freq. FFPE hybrid | Allele freq. FFPE read-based | Expected CNV based on S5 | Detected CNV |
|---|---|---|---|---|---|---|---|---|
| Adenocarcinoma ductal | AB 2 | KRAS COSM521_p.G12D | 4.03% | 9.4% | 9.4% | 10.8% | | |
| Invasive adenocarcinoma | AB 3 | IDH1 COSM97131_p.V178I | 45.54% | 48.7% | 51.2% | 49.9% | | |
| | | EGFR COSM6224_p.L858R | 13.81% | 9.5% | 13.9% | 15.1% | | |
| Colon adenocarcinoma | AB 4 | BRAF COSM476_p.V600E | 18.75% | 34.2% | 17.2% | 17.3% | | |
| Invasive carcinoma of no special type (NCT) | AB 5 | none | none | none | none | none | | |
| Glioblastoma multiforme | AB 8 | none | none | none | none | none | EGFR, 40 | EGFR gain (22x) |
| Melanoma | AB 10 | NRAS COSM584_p.Q61R | 18.57% | 28.6% | 25.3% | 26.5% | | |
| Squamous cell carcinoma | AB 11 | HRAS COSM487_p.G13S | 11.83% | 25.0% | 21.6% | 21.6% | | |
| Infiltrative urothelial carcinoma (high grade) | AB 14 | none | none | none | none | none | FGFR1, 6 | FGFR1 gain (3x) |
| Melanoma | AB 1 | BRAF COSM476_p.V600E | 63.16% | 88.9% | 65.2% | 65.2% | | |
| Invasive carcinoma of no special type (NCT) | AB 6 | PIK3CA COSM763_p.E545K | 27.59% | 14.6% | 13.2% | 13.2% | | |
| Squamous cell carcinoma | AB 12 | TP53 COSM10660_p.R273H | 23.88% | 23.7% | 22.2% | 23.4% | | CDKN2A loss (0.6x) |
| Glioblastoma multiforme | AB 20 | none | none | none | none | none | EGFR, 42 | EGFR gain (24x) |

4G: Detection of Fusions Across ALK, ROS1, RET, NTRK1, NTRK2, and NTRK3 Driver Genes.

Library preparation, sequencing and analysis was carried out for evaluation of performance of the assay in detecting fusion variants The assay was able to reproducibly detect 11 fusion isoforms representing 6 driver genes (ALK, BRAF FGFR3, NTRK1, NTRK3, RET, and ROS1), as well as 15 NTRK fusion isoforms representing 3 driver genes (NTRK1, NTRK2, and NTRK3) using targeted isoform detection.

| Material | Fusion Isoform | Replicate 1 (read / molecular counts) | Replicate 2 (read / molecular counts) |
|---|---|---|---|
| SeraCare Seraseq FFPE Tumor Fusion RNA Reference Material | CD74-ROS1.C6R34 | 78 / 6 | 141 / 12 |
| | EML4-ALK.E13A20 | 583 / 18 | 530 / 21 |
| | ETV6-NTRK3.E5N15 | 639 / 34 | 307 / 17 |
| | FGFR3-BAIAP2L1.F17B2 | 343 / 14 | 443 / 24 |
| | FGFR3-TACC3.F17T11 | 504 / 26 | 360 / 22 |
| | KIF5B-RET.K24R11 | 333 / 20 | 153 / 3 |
| | LMNA-NTRK1.L2N11 | 819 / 22 | 815 / 26 |
| | NCOA4-RET.N7R12 | 664 / 22 | 805 / 25 |
| | SLC34A2-ROS1.S4R34 | 74 / 4 | 121 / 9 |
| | SLC45A3-BRAF.S1B8 | 519 / 35 | 566 / 34 |
| | TPM3-NTRK1.T7N10 | 553 / 28 | 464 / 30 |

-continued

| Material | Fusion Isoform | Replicate 1 (read / molecular counts) | Replicate 2 (read / molecular counts) |
|---|---|---|---|
| SeraCare Seraseq FFPE NTRK Fusion RNA Reference Material | AFAP1-NTRK2.A14N10 | 2542 / 157 | 1823 / 137 |
| | BTBD1-NTRK3.B4N14 | 1676 / 153 | 1753 / 169 |
| | ETV6-NTRK3.E4N14 | 1892 / 144 | 1815 / 161 |
| | ETV6-NTRK3.E4N15 | 2224 / 132 | 2348 / 164 |
| | ETV6-NTRK3.E5N14 | 1605 / 132 | 1775 / 145 |
| | ETV6-NTRK3.E5N15 | 2811 / 160 | 2208 / 165 |
| | IRF2BP2-NTRK1.I1N9 | 1584 / 122 | 1877 / 156 |
| | LMNA-NTRK1.L11N11 | 3618 / 184 | 3000 / 185 |
| | NACC2-NTRK2.N4N12 | 1839 / 94 | 1626 / 106 |
| | PAN3-NTRK2.P1N15 | 772 / 48 | 783 / 68 |
| | QKI-NTRK2.Q6N14 | 2376 / 196 | 1891 / 181 |
| | SQSTM1-NTRK1.S5N9 | 4679 / 186 | 3260 / 159 |
| | TFG-NTRK1.T5N9 | 1842 / 141 | 1529 / 134 |
| | TPM3-NTRK1.T7N9 | 2645 / 185 | 2891 / 207 |
| | TRIM24-NTRK2.T12N13 | 2940 / 112 | 1969 / 92 |

4H: Detection of EGFR and KRAS Variants in Control Materials

| Material | Variant | Variant Type | Expected AF % | Replicate 1 Observed AF % | Replicate 2 Observed AF % |
|---|---|---|---|---|---|
| Horizon 5% FFPE | EGFR p.G719S | SNV | 5% | 6.02% | 8.45% |
| | EGFR p.E746_A750delELREA | INDEL | 5% | 3.26% | 5.26% |
| | EGFR p.T790M | SNV | 5% | 6.76% | 4.40% |
| | EGFR p.L858R | SNV | 5% | 5.00% | 5.29% |
| Horizon 1% FFPE | EGFR p.G719S | SNV | 1% | ND | 1.46% |
| | EGFR p.E746_A750delELREA | INDEL | 1% | 1.35% | 1.08% |
| | EGFR p.T790M | SNV | 1% | 2.21% | 0.77% |
| | EGFR p.L858R | SNV | 1% | 1.53% | 1.00% |
| KRAS Gene-Specific Multiplex Reference Standard 5% FFPE | NRAS p.Q61K | SNV | 5% | 2.46% | 3.67% |
| | NRAS p.G12V | SNV | 5% | 5.51% | 4.26% |
| | KRAS p.A146T | SNV | 5% | 2.94% | 4.00% |
| | KRAS p.Q61H | SNV | 5% | 6.45% | 5.66% |
| | KRAS p.G13D | SNV | 5% | 2.48% | 6.14% |
| | KRAS p.G12D | SNV | 5% | 2.97% | 3.07% |

Library preparation, sequencing and analysis was carried out for evaluation of performance of the assay in detecting variants of EGFR Using Horizon EGFR Gene-Specific Multiplex Reference Standard 5% and 1% FFPE Controls; and in detecting fusion variants of RAS Using Horizon KRAS Gene-Specific Multiplex Reference Standard 5% FFPE. The assay was able to detect all EGFR variants at 5% allele frequency using a Horizon FFPE control. At 1% allele frequency—which is below typical LOD—the assay picked up 7 out of 8 instances across 2 replicates: The assay was able to reproducibly detect 6 RAS mutations using Horizon control.

41: Detection of KRAS, BRAF, KIT, EGFR Mutations using cfDNA Controls

Library preparation, sequencing and analysis was carried out for evaluation of performance of the assay in detecting KRAS, BRAF, KIT, EGFR mutations using cfDNA controls SeraCare Seraseq ctDNA Reference Material v2 AF 0.125% or Horizon Multiplex I cfDNA Reference Standard Set (1% and 0.1%). The assay was able to detect mutations down to an allele frequency of 0.1% using cfDNA controls.

| Material | Variant | Type | Expected AF | Replicate 1 Observed AF | Replicate 2 Observed AF |
|---|---|---|---|---|---|
| Seraseq ctDNA | KRAS G12D | SNV | 0.11% | 0.089% | ND |
| | BRAF V600E | SNV | 0.14% | 0.111% | 0.206% |
| | KIT D816V | SNV | 0.125% | 0.193% | ND |
| | EGFR p.E746_A750 delELREA | INDEL | 0.12% | 0.155% | 0.143% |
| | EGFR p.D770_N771insG | INDEL | 0.18% | 0.101% | 0.086% |
| | EGFR T790M | SNV | 0.18% | 0.177% | 0.184% |
| | EGFR L858R | SNV | 0.17% | 0.225% | ND |
| Horizon 1% | KRAS G12D | SNV | 1% | 1.272% | 1.269% |
| Horizon 0.1% | KRAS G12D | SNV | 0.1% | 0.094% | 0.232% |

4J: Detection of MET and PTEN Copy Number Variation

Library preparation, sequencing and analysis was carried out for evaluation of performance of the assay in detection of MET copy gain and PTEN copy loss using control and cell line. Structural Multiplex FFPE Reference Standard (Horizon) was utilized to detect MET, and a PTEN cell line (ATCC) was used for detection of PTEN copy number variation. The assay was able to detect the MET copy number gain and PTEN copy number loss using control and cell line, respectively.

| Sample | Gene | Expected CNV Status | Expected Copy Number | Observed Copy Number R1 | Observed Copy Number R2 |
|---|---|---|---|---|---|
| Wild-type | MET | | 2 | 2.3 | 2.3 |
| Horizon | MET | | 4.5 | 4.6 | 4.6 |
| Wild-type | PTEN | | 2 | 2.5 | 2.6 |
| Cell Line | PTEN | | 0 | 0 | 0 |

4K: Detection of NTRK1, FGFR3, RET Fusions in Cell Lines.

Library preparation, sequencing and analysis was carried out for evaluation of performance of the assay in detection in NTRK1, FGFR3, RET fusion cell lines. KM12 cell line (ATCC); SW780 cell line (ATCC); LC-2/ad cell line (Sigma Aldrich) were used for nucleic acid preparation and evaluation. The assay was able to detect the TPM3-NTRK1 fusion isoform using both the targeted isoform and imbalance assay methods of the assay. The assay was able to detect the FGFR3-BAIAP2L1 fusion isoform using both the targeted isoform and imbalance assay methods of the assay. Interestingly, an ALK imbalance was also detected in this cell line; research is ongoing to understand these results further The assay was able to detect the CCDC6-RET fusion isoform using both the targeted isoform and imbalance assay methods

| Targeted Isoform | Rep | Targeted Isoform | Read Count | Molecular Counts | Imbalance Assay | Imbalance Score | Imbalance p-value |
|---|---|---|---|---|---|---|---|
| TPM3-NTRK1.T7N10 | 1 | DETECTED | 4430 | 360 | DETECTED | 2.781 | 0.0017 |
|  | 2 | DETECTED | 6665 | 531 |  |  |  |
| FGFR3-BAIAP2L1.F17B2 | 1 | DETECTED | 9096 | 763 | DETECTED | 1.716 | 0.0066 |
|  | 2 | DETECTED | 10913 | 952 |  |  |  |
| CCDC6-RET.C1R12 | 1 | DETECTED | 3342 | 318 | DETECTED | 1.763 | 0.0055 |
|  | 2 | DETECTED | 3233 | 301 |  |  |  |

4L: Detection of ALK and ROS1 Fusions in FFPE Samples

Library preparation, sequencing and analysis was carried out for evaluation of performance of the assay in detection of ALK and ROS1 fusions in FFPE samples. The assay was able to detect the ALK fusions using both the targeted isoform and imbalance assay methods, and ROS1 fusions using the targeted isoform method for FFPE samples

| Sample | Targeted Isoform | Isoform | Read Count | Molecular Counts | Imbalance Assay | Imbalance Score | Imbalance p-value |
|---|---|---|---|---|---|---|---|
| 1 | DETECTED | EML4-ALK.E13A20 | 1535 | 50 | DETECTED | 4.767 | 0.0007 |
|  | DETECTED | EML4-ALK.E6A20 | 6665 | 531 |  |  |  |
| 2 | DETECTED | CD74-ROS1.C6R33 | 85 | 5 | No imbalance assays for ROS1 | | |
|  | DETECTED | CD74-ROS1.C6R34 | 1566 | 110 |  |  |  |

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments of the invention described herein may be employed in practicing the invention. It is intended that the following claims define the scope of the invention and that methods and structures within the scope of these claims and their equivalents be covered thereby.

TABLE A primer sequences of the oncology precision assay, FWD pool and REV pool

| SEQ ID NO | PrimerSeqFWD (A) | SEQ ID NO | PrimerSeqREV (B) |
|---|---|---|---|
| 1 | TCTGTACGGTGACAAGGCGUNNNACTNNNTGAUCGAGUCGGGCTCUGGA | 997 | TGACAAGGCGTAGTCACGGUNNNACTNNNTGAUCCGCUGUGGCCCUCGUG |
| 2 | TCTGTACGGTGACAAGGCGUNNNACTNNNTGAUGCACGGGUCGGGUGAGA | 998 | TGACAAGGCGTAGTCACGGUNNNACTNNNTGAUGACAGCGGCUGCGAUCA |
| 3 | TCTGTACGGTGACAAGGCGUNNNACTNNNTGAUGUGGUGCCGAGCCUCUG | 999 | TGACAAGGCGTAGTCACGGUNNNACTNNNTGAUGGUCGCCCUCCACGCAG |
| 4 | TCTGTACGGTGACAAGGCGUNNNACTNNNTGAUGGGCCGUUAGGGUGCAG | 1000 | TGACAAGGCGTAGTCACGGUNNNACTNNNTGAUAAGUGCCCAGCGAGCUA |
| 5 | TCTGTACGGTGACAAGGCGUNNNACTNNNTGAUUGCCUCACCUCCACCGT | 1001 | TGACAAGGCGTAGTCACGGUNNNACTNNNTGAUCAAUGCCGAUGGCCUCC |
| 6 | TCTGTACGGTGACAAGGCGUNNNACTNNNTGAUGUUCUGCGCAGCUUCCC | 1002 | TGACAAGGCGTAGTCACGGUNNNACTNNNTGAUAGACGACAGGGCUGGUT |
| 7 | TCTGTACGGTGACAAGGCGUNNNACTNNNTGAUGAUGGCCAUGGCGCGGA | 1003 | TGACAAGGCGTAGTCACGGUNNNACTNNNTGAUACUGGCAUGACCCCCAC |
| 8 | TCTGTACGGTGACAAGGCGUNNNACTNNNTGAUUGUCGUCUCUCCAGCCC | 1004 | TGACAAGGCGTAGTCACGGUNNNACTNNNTGAUGGCUCUCGCGGAGGAAG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 9 | TCTGTACGGTGACAAGGCGUNNNACTNNNTGAUGGCCCCUGAGCGUCAUC | 1005 | TGACAAGGCGTAGTCACGGUNNNACTNNNTGAUUUUGUUGGCGGGCAACC |
| 10 | TCTGTACGGTGACAAGGCGUNNNACTNNNTGAUCGUCUGAGGAGCCCGUG | 1006 | TGACAAGGCGTAGTCACGGUNNNACTNNNTGAUGCAGUCCGGCUUGGAGG |
| 11 | TCTGTACGGTGACAAGGCGUNNNACTNNNTGAUAGCGUCCUCCCAGCGUA | 1007 | TGACAAGGCGTAGTCACGGUNNNACTNNNTGAUAAGUCCUGCCGAGCACT |
| 12 | TCTGTACGGTGACAAGGCGUNNNACTNNNTGAUGGCGACCCCCUCAUCAT | 1008 | TGACAAGGCGTAGTCACGGUNNNACTNNNTGAUACUGGUUGGUGGCUGGA |
| 13 | TCTGTACGGTGACAAGGCGUNNNACTNNNTGAUACUUGGAGGACCGUCGC | 1009 | TGACAAGGCGTAGTCACGGUNNNACTNNNTGAUAGCUGCAUGGUGCGGUT |
| 14 | TCTGTACGGTGACAAGGCGUNNNACTNNNTGAUCUGGGACAGUGGGCCAA | 1010 | TGACAAGGCGTAGTCACGGUNNNACTNNNTGAUAGGCUCCAGUGCUGGUT |
| 15 | TCTGTACGGTGACAAGGCGUNNNACTNNNTGAUCAGCUGGGCCAGAGUGT | 1011 | TGACAAGGCGTAGTCACGGUNNNACTNNNTGAUAGGCUCCUCCAGGCUCA |
| 16 | TCTGTACGGTGACAAGGCGUNNNACTNNNTGAUAACAUGGCCUCCUCCGC | 1012 | TGACAAGGCGTAGTCACGGUNNNACTNNNTGAUAUCCUCUGCCCCACCCT |
| 17 | TCTGTACGGTGACAAGGCGUNNNACTNNNTGAUCAGGUCCCCAUGGUGGC | 1013 | TGACAAGGCGTAGTCACGGUNNNACTNNNTGAUCAACAUGGCCUGGCAGC |
| 18 | TCTGTACGGTGACAAGGCGUNNNACTNNNTGAUGGGCGCCUUCCAUGGAG | 1014 | TGACAAGGCGTAGTCACGGUNNNACTNNNTGAUCAAAAAGGGAUUCAAUUGCCAUCCA |
| 19 | TCTGTACGGTGACAAGGCGUNNNACTNNNTGAUGUGCAGCAGUGGAGCCA | 1015 | TGACAAGGCGTAGTCACGGUNNNACTNNNTGAUCAUCUCCACCGCCGUGT |
| 20 | TCTGTACGGTGACAAGGCGUNNNACTNNNTGAUUCCAGGACGUGCUGCUC | 1016 | TGACAAGGCGTAGTCACGGUNNNACTNNNTGAUCCCAUCCUCUGGAGCCA |
| 21 | TCTGTACGGTGACAAGGCGUNNNACTNNNTGAUCUGGGCAACGUGGUUGG | 1017 | TGACAAGGCGTAGTCACGGUNNNACTNNNTGAUCCCCCACCUGAGACUCC |
| 22 | TCTGTACGGTGACAAGGCGUNNNACTNNNTGAUUCCAUCGAGCCUCCGAC | 1018 | TGACAAGGCGTAGTCACGGUNNNACTNNNTGAUCUGCUUGGCCUGGAGGG |
| 23 | TCTGTACGGTGACAAGGCGUNNNACTNNNTGAUGCUGCAACCUGCAGCAC | 1019 | TGACAAGGCGTAGTCACGGUNNNACTNNNTGAUGAGCUGAGCGCCUGGCA |
| 24 | TCTGTACGGTGACAAGGCGUNNNACTNNNTGAUUUUUGGUGGCACGCAGC | 1020 | TGACAAGGCGTAGTCACGGUNNNACTNNNTGAUGAUGUCCCGGCGCUUGA |
| 25 | TCTGTACGGTGACAAGGCGUNNNACTNNNTGAUUGUCUUCCCCAACGGCA | 1021 | TGACAAGGCGTAGTCACGGUNNNACTNNNTGAUGCACACGCGGAUGUGCA |
| 26 | TCTGTACGGTGACAAGGCGUNNNACTNNNTGAUGGCGUGGAGCUAUGGGT | 1022 | TGACAAGGCGTAGTCACGGUNNNACTNNNTGAUGCGUGACCGGGACUUCC |
| 27 | TCTGTACGGTGACAAGGCGUNNNACTNNNTGAUCCUGCCCCCACUCCCAG | 1023 | TGACAAGGCGTAGTCACGGUNNNACTNNNTGAUGGCAGCAGGGUGGUGAG |
| 28 | TCTGTACGGTGACAAGGCGUNNNACTNNNTGAUGAGGCCUCCUGCACUCC | 1024 | TGACAAGGCGTAGTCACGGUNNNACTNNNTGAUGGCCACCUGGACCUUCC |
| 29 | TCTGTACGGTGACAAGGCGUNNNACTNNNTGAUAGGACGGUCGGACUCCC | 1025 | TGACAAGGCGTAGTCACGGUNNNACTNNNTGAUGGCCAGACUGACCCUCC |
| 30 | TCTGTACGGTGACAAGGCGUNNNACTNNNTGAUCAGGCGAUGUCGCCGAA | 1026 | TGACAAGGCGTAGTCACGGUNNNACTNNNTGAUGGCCCGUGUCUUGGAGG |
| 31 | TCTGTACGGTGACAAGGCGUNNNACTNNNTGAUGGCUUCGAGGCCGUUGA | 1027 | TGACAAGGCGTAGTCACGGUNNNACTNNNTGAUGGGUAGGCCGUGUCUGG |
| 32 | TCTGTACGGTGACAAGGCGUNNNACTNNNTGAUGCGAAGGCGUCUCCCUG | 1028 | TGACAAGGCGTAGTCACGGUNNNACTNNNTGAUGUCAGCCAGGGCACCUG |
| 33 | TCTGTACGGTGACAAGGCGUNNNACTNNNTGAUGGCGGCUUGGGAGAAUG | 1029 | TGACAAGGCGTAGTCACGGUNNNACTNNNTGAUGUCAGCCCCAGGGAUGG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 34 | TCTGTACGGTGACAAGGCGUNNNACTNNNTGAUCUACACGGUGCGCGAGG | 1030 | TGACAAGGCGTAGTCACGGUNNNACTNNNTGAUGUGUCCUCCGCUGAGGC |
| 35 | TCTGTACGGTGACAAGGCGUNNNACTNNNTGAUUGUGUCCAGAGGACCCC | 1031 | TGACAAGGCGTAGTCACGGUNNNACTNNNTGAUUCAGGGCUCUGCAGCUC |
| 36 | TCTGTACGGTGACAAGGCGUNNNACTNNNTGAUGGAGCCAUGGGCUGCAT | 1032 | TGACAAGGCGTAGTCACGGUNNNACTNNNTGAUUCCACGCUGCUCGGCAT |
| 37 | TCTGTACGGTGACAAGGCGUNNNACTNNNTGAUCGGCUCAGUGAGGCUCG | 1033 | TGACAAGGCGTAGTCACGGUNNNACTNNNTGAUUCCGGCAUUCGUGUUGC |
| 38 | TCTGTACGGTGACAAGGCGUNNNACTNNNTGAUGGUGCCACCCGCCUAUG | 1034 | TGACAAGGCGTAGTCACGGUNNNACTNNNTGAUUCUCUGGGAGGGCACUG |
| 39 | TCTGTACGGTGACAAGGCGUNNNACTNNNTGAUGGAGUGCUGGCAUGCCG | 1035 | TGACAAGGCGTAGTCACGGUNNNACTNNNTGAUUGAUGGUCGAGGUGCGG |
| 40 | TCTGTACGGTGACAAGGCGUNNNACTNNNTGAUGCUGGUGGAGGACCUGG | 1036 | TGACAAGGCGTAGTCACGGUNNNACTNNNTGAUUGCACGUCGGUUUUGGG |
| 41 | TCTGTACGGTGACAAGGCGUNNNACTNNNTGAUUUGGCACUGAGGGUCGC | 1037 | TGACAAGGCGTAGTCACGGUNNNACTNNNTGAUUGGCCGCUCCAACUCAC |
| 42 | TCTGTACGGTGACAAGGCGUNNNACTNNNTGAUGAACCCGCGCUCUCUGA | 1038 | TGACAAGGCGTAGTCACGGUNNNACTNNNTGAUUGUUGCACUGUGCCUGG |
| 43 | TCTGTACGGTGACAAGGCGUNNNACTNNNTGAUAGAGCUCGGCUGUUCCA | 1039 | TGACAAGGCGTAGTCACGGUNNNACTNNNTGAUUUUUUCCGCGGCACCUC |
| 44 | TCTGTACGGTGACAAGGCGUNNNACTNNNTGAUCCUCAGAGCCCCACCUG | 1040 | TGACAAGGCGTAGTCACGGUNNNACTNNNTGAUCUCCUUCCUUGCCAACGC |
| 45 | TCTGTACGGTGACAAGGCGUNNNACTNNNTGAUCGUGCUGGAGAGACCCC | 1041 | TGACAAGGCGTAGTCACGGUNNNACTNNNTGAUUGAGCCCACCUGACUUGG |
| 46 | TCTGTACGGTGACAAGGCGUNNNACTNNNTGAUGGGAGCCGUCAACGAUG | 1042 | TGACAAGGCGTAGTCACGGUNNNACTNNNTGAUGCUGCCGAAGACCAACUG |
| 47 | TCTGTACGGTGACAAGGCGUNNNACTNNNTGAUCGUGCCCUCCGUGUUCA | 1043 | TGACAAGGCGTAGTCACGGUNNNACTNNNTGAUGAGCCCAGGCCUUUCUUG |
| 48 | TCTGTACGGTGACAAGGCGUNNNACTNNNTGAUCCGGCGUCCACAACUCA | 1044 | TGACAAGGCGTAGTCACGGUNNNACTNNNTGAUAGGAACUCCCGCAGGUUT |
| 49 | TCTGTACGGTGACAAGGCGUNNNACTNNNTGAUAGGAGAUGCCGUCGGUG | 1045 | TGACAAGGCGTAGTCACGGUNNNACTNNNTGAUCUCCACCCCUGAAGCCUG |
| 50 | TCTGTACGGTGACAAGGCGUNNNACTNNNTGAUGCUGGCCUUCGUACGGG | 1046 | TGACAAGGCGTAGTCACGGUNNNACTNNNTGAUCCGUCUCCUCCACGGAUG |
| 51 | TCTGTACGGTGACAAGGCGUNNNACTNNNTGAUAUCUGCCAGCGGCUCAG | 1047 | TGACAAGGCGTAGTCACGGUNNNACTNNNTGAUGUGAGGCAGAUGCCCAGC |
| 52 | TCTGTACGGTGACAAGGCGUNNNACTNNNTGAUAGCUGCAUGAUCUGCGG | 1048 | TGACAAGGCGTAGTCACGGUNNNACTNNNTGAUGGAGGUGGUGGUGGUCCC |
| 53 | TCTGTACGGTGACAAGGCGUNNNACTNNNTGAUGCCGUCAUGAGACCCGA | 1049 | TGACAAGGCGTAGTCACGGUNNNACTNNNTGAUCUAGUUGCAUGGGUGGCG |
| 54 | TCTGTACGGTGACAAGGCGUNNNACTNNNTGAUCAGCCUCUCUGCCCAGC | 1050 | TGACAAGGCGTAGTCACGGUNNNACTNNNTGAUCCAGAUCAUCCGCGAGCT |
| 55 | TCTGTACGGTGACAAGGCGUNNNACTNNNTGAUCGUUCUGCCUCCCGUGG | 1051 | TGACAAGGCGTAGTCACGGUNNNACTNNNTGAUGUGAGCCUGCAAUCCCUG |
| 56 | TCTGTACGGTGACAAGGCGUNNNACTNNNTGAUAGCCGACCUUGAGGCUG | 1052 | TGACAAGGCGTAGTCACGGUNNNACTNNNTGAUUUACCCUUGGCCGCGUAC |
| 57 | TCTGTACGGTGACAAGGCGUNNNACTNNNTGAUCCCUCUCAUGCCCGCAG | 1053 | TGACAAGGCGTAGTCACGGUNNNACTNNNTGAUCUCACAGGUCGUGUGUGC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 58 | TCTGTACGGTGACAAGGCGUNNNACTNNNTGAUGUCCCAGUGGCCCUCGG | 1054 | TGACAAGGCGTAGTCACGGUNNNACTNNNTGAUGUACCGGAGGAAGCGGUT |
| 59 | TCTGTACGGTGACAAGGCGUNNNACTNNNTGAUGAGGCCACUGGGUCACC | 1055 | TGACAAGGCGTAGTCACGGUNNNACTNNNTGAUAACCUGCAGCAUGAGCAC |
| 60 | TCTGTACGGTGACAAGGCGUNNNACTNNNTGAUCUGGAGAUGGCCCGACA | 1056 | TGACAAGGCGTAGTCACGGUNNNACTNNNTGAUACAUGUCCCGCUGGUCG |
| 61 | TCTGTACGGTGACAAGGCGUNNNACTNNNTGAUCACCGUCUCCUCGGAGC | 1057 | TGACAAGGCGTAGTCACGGUNNNACTNNNTGAUAUCAGCGAGAGUGGCAGG |
| 62 | TCTGTACGGTGACAAGGCGUNNNACTNNNTGAUGUGCUCCCAGCAAGCGA | 1058 | TGACAAGGCGTAGTCACGGUNNNACTNNNTGAUAUGCCAGGUGCAAGCACA |
| 63 | TCTGTACGGTGACAAGGCGUNNNACTNNNTGAUAUCACCGCAUCGUGCAG | 1059 | TGACAAGGCGTAGTCACGGUNNNACTNNNTGAUCACGACUGUUGGACCGUG |
| 64 | TCTGTACGGTGACAAGGCGUNNNACTNNNTGAUAUCCGCUCGUCCACCAG | 1060 | TGACAAGGCGTAGTCACGGUNNNACTNNNTGAUCAGCGAAUGGGCAGCAUG |
| 65 | TCTGTACGGTGACAAGGCGUNNNACTNNNTGAUGCUCGCCCACGAGUAGC | 1061 | TGACAAGGCGTAGTCACGGUNNNACTNNNTGAUCAGGAGUCCGAGGUGGUG |
| 66 | TCTGTACGGTGACAAGGCGUNNNACTNNNTGAUCAGCGCCACCUGCUGAC | 1062 | TGACAAGGCGTAGTCACGGUNNNACTNNNTGAUCCAGUAGCGCUGCUUCCT |
| 67 | TCTGTACGGTGACAAGGCGUNNNACTNNNTGAUCCGCCUCUCACCAUCGA | 1063 | TGACAAGGCGTAGTCACGGUNNNACTNNNTGAUCCGUGGAGCUCCUCACAC |
| 68 | TCTGTACGGTGACAAGGCGUNNNACTNNNTGAUCUCGAGCCCGGGAAGUG | 1064 | TGACAAGGCGTAGTCACGGUNNNACTNNNTGAUCGGGAAGCGGGAGAUCUT |
| 69 | TCTGTACGGTGACAAGGCGUNNNACTNNNTGAUGGGACUCGAUGGACCGC | 1065 | TGACAAGGCGTAGTCACGGUNNNACTNNNTGAUCUCUUGCGGGUACCCACG |
| 70 | TCTGTACGGTGACAAGGCGUNNNACTNNNTGAUUACUGCCUGGCUGGCUG | 1066 | TGACAAGGCGTAGTCACGGUNNNACTNNNTGAUCUGCUUCCUCAAGGCCGA |
| 71 | TCTGTACGGTGACAAGGCGUNNNACTNNNTGAUUUGUGCCCACCAGGCAA | 1067 | TGACAAGGCGTAGTCACGGUNNNACTNNNTGAUCUGUAGGGACACAGGGCA |
| 72 | TCTGTACGGTGACAAGGCGUNNNACTNNNTGAUAAUCUCCUGCGCCCUGG | 1068 | TGACAAGGCGTAGTCACGGUNNNACTNNNTGAUGCCAUGCGGGUCUCUCUG |
| 73 | TCTGTACGGTGACAAGGCGUNNNACTNNNTGAUCUGAUUGCUCCGGCCGT | 1069 | TGACAAGGCGTAGTCACGGUNNNACTNNNTGAUGCCUCCGGAAGGUCAUCT |
| 74 | TCTGTACGGTGACAAGGCGUNNNACTNNNTGAUCUGGAGGCACUGAGGCG | 1070 | TGACAAGGCGTAGTCACGGUNNNACTNNNTGAUGCCUUUUGUCCGGCUCCT |
| 75 | TCTGTACGGTGACAAGGCGUNNNACTNNNTGAUCUCCGCCAUGCAAGGCT | 1071 | TGACAAGGCGTAGTCACGGUNNNACTNNNTGAUGCUCGUGUCCCCAACAA |
| 76 | TCTGTACGGTGACAAGGCGUNNNACTNNNTGAUGGUCCAGGGAGAGCCUG | 1072 | TGACAAGGCGTAGTCACGGUNNNACTNNNTGAUGGCGAUCUCCUCGUUUGC |
| 77 | TCTGTACGGTGACAAGGCGUNNNACTNNNTGAUGUCCGACUCCGAGGACG | 1073 | TGACAAGGCGTAGTCACGGUNNNACTNNNTGAUGGGCUUGUCUUGAGGCUG |
| 78 | TCTGTACGGTGACAAGGCGUNNNACTNNNTGAUCUGCUGCAGAACGGGAG | 1074 | TGACAAGGCGTAGTCACGGUNNNACTNNNTGAUGUGAGGGCUGACGCAGAG |
| 79 | TCTGTACGGTGACAAGGCGUNNNACTNNNTGAUUGUCGUUCCGCUUCGGG | 1075 | TGACAAGGCGTAGTCACGGUNNNACTNNNTGAUGUGGGCUCAGGAACCGAG |
| 80 | TCTGTACGGTGACAAGGCGUNNNACTNNNTGAUUCCAGCAAGGCCUGGUG | 1076 | TGACAAGGCGTAGTCACGGUNNNACTNNNTGAUUACCCGAGGUCCCUGGAG |
| 81 | TCTGTACGGTGACAAGGCGUNNNACTNNNTGAUGCUAGCUUUGGCGAGGG | 1077 | TGACAAGGCGTAGTCACGGUNNNACTNNNTGAUUCAGCGCGAUCAGCAUCT |
| 82 | TCTGTACGGTGACAAGGCGUNNNACTNNNTGAUUGAGCUUGCCCUGACCC | 1078 | TGACAAGGCGTAGTCACGGUNNNACTNNNTGAUUCCGCAGGCUUCCUUAGG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 83 | TCTGTACGGTGACAAGGCGUNNNACTNNNTGAUAUGAGGGCGAUGGGCUG | 1079 | TGACAAGGCGTAGTCACGGUNNNACTNNNTGAUUCUGCAGAGGACUCCAGC |
| 84 | TCTGTACGGTGACAAGGCGUNNNACTNNNTGAUCAGUGAGCUGCCUGCGT | 1080 | TGACAAGGCGTAGTCACGGUNNNACTNNNTGAUGGGUCUCUGUGAGGGCA |
| 85 | TCTGTACGGTGACAAGGCGUNNNACTNNNTGAUCUGCGGCGAGUCCUGAG | 1081 | TGACAAGGCGTAGTCACGGUNNNACTNNNTGAUUUCUUCCCGCCUUUCCCG |
| 86 | TCTGTACGGTGACAAGGCGUNNNACTNNNTGAUUGGCUCCGGGUGACAGC | 1082 | TGACAAGGCGTAGTCACGGUNNNACTNNNTGAUGAUCUCCCAGAGCAGGACC |
| 87 | TCTGTACGGTGACAAGGCGUNNNACTNNNTGAUAGAGCGGACUCCCCUCG | 1083 | TGACAAGGCGTAGTCACGGUNNNACTNNNTGAUCUGCACACACCAGUUGAGC |
| 88 | TCTGTACGGTGACAAGGCGUNNNACTNNNTGAUGUCCAGCAUCCGACCAC | 1084 | TGACAAGGCGTAGTCACGGUNNNACTNNNTGAUACAUAGUCCCGGAAGCUGC |
| 89 | TCTGTACGGTGACAAGGCGUNNNACTNNNTGAUGUCCCUGCUGUCUGCCG | 1085 | TGACAAGGCGTAGTCACGGUNNNACTNNNTGAUGGUACGCCUCCAGAUGAGC |
| 90 | TCTGTACGGTGACAAGGCGUNNNACTNNNTGAUAGAUGCAGCCGUGCCAG | 1086 | TGACAAGGCGTAGTCACGGUNNNACTNNNTGAUUGUACACGUCCCGGGACAT |
| 91 | TCTGTACGGTGACAAGGCGUNNNACTNNNTGAUGCUCGGCAGCCGCAGAA | 1087 | TGACAAGGCGTAGTCACGGUNNNACTNNNTGAUUGAGGUUGGAGUCCAUGGG |
| 92 | TCTGTACGGTGACAAGGCGUNNNACTNNNTGAUCUCCAGGAGGUGGAGGG | 1088 | TGACAAGGCGTAGTCACGGUNNNACTNNNTGAUGCACCUGGCUCCUCUUCAC |
| 93 | TCTGTACGGTGACAAGGCGUNNNACTNNNTGAUUUCCUGAGCCAGCAGGG | 1089 | TGACAAGGCGTAGTCACGGUNNNACTNNNTGAUAUUCCUACCGGAAGCAGGT |
| 94 | TCTGTACGGTGACAAGGCGUNNNACTNNNTGAUCUCCAUUCCCGGGAGGG | 1090 | TGACAAGGCGTAGTCACGGUNNNACTNNNTGAUCGUGUGAUGCAGCUCUUCG |
| 95 | TCTGTACGGTGACAAGGCGUNNNACTNNNTGAUAGGCUCCACCUCAGCAG | 1091 | TGACAAGGCGTAGTCACGGUNNNACTNNNTGAUCUUGUGCCCACGAAGGAGT |
| 96 | TCTGTACGGTGACAAGGCGUNNNACTNNNTGAUCUGAAGUCAGCCGGCUC | 1092 | TGACAAGGCGTAGTCACGGUNNNACTNNNTGAUCUAGUCCCUGGCUGGACCA |
| 97 | TCTGTACGGTGACAAGGCGUNNNACTNNNTGAUCCAGGACGCCUUCUGCA | 1093 | TGACAAGGCGTAGTCACGGUNNNACTNNNTGAUCUCUUGACCAGCACGUUCC |
| 98 | TCTGTACGGTGACAAGGCGUNNNACTNNNTGAUAUGCCCAGGCUGGGAAG | 1094 | TGACAAGGCGTAGTCACGGUNNNACTNNNTGAUCGGUUUUCCCGGACAUGGT |
| 99 | TCTGTACGGTGACAAGGCGUNNNACTNNNTGAUCCUCACCACGAGCUGCC | 1095 | TGACAAGGCGTAGTCACGGUNNNACTNNNTGAUCUGCUGUGUGCUGGCAGAT |
| 100 | TCTGTACGGTGACAAGGCGUNNNACTNNNTGAUGCUGGACCAGACCCUGC | 1096 | TGACAAGGCGTAGTCACGGUNNNACTNNNTGAUGAUGCACCACGGCCACAUA |
| 101 | TCTGTACGGTGACAAGGCGUNNNACTNNNTGAUCAUGAGUCGGCCUGUGG | 1097 | TGACAAGGCGTAGTCACGGUNNNACTNNNTGAUAUCAGAACUGCCGACCACA |
| 102 | TCTGTACGGTGACAAGGCGUNNNACTNNNTGAUCCCACCCUUCCGACCUC | 1098 | TGACAAGGCGTAGTCACGGUNNNACTNNNTGAUCCUCUUGACCUGUCCAGGC |
| 103 | TCTGTACGGTGACAAGGCGUNNNACTNNNTGAUUCUUCCCGGGUCCCGAG | 1099 | TGACAAGGCGTAGTCACGGUNNNACTNNNTGAUCCAUGCUGGACCUUCUGCA |
| 104 | TCTGTACGGTGACAAGGCGUNNNACTNNNTGAUCGGUGGGCAGCCAGGAG | 1100 | TGACAAGGCGTAGTCACGGUNNNACTNNNTGAUGGACGACCCAGAGCUGAUG |
| 105 | TCTGTACGGTGACAAGGCGUNNNACTNNNTGAUAAGGCUUUGGUCCAGCCA | 1101 | TGACAAGGCGTAGTCACGGUNNNACTNNNTGAUCUUGCAGUGGAACUCCACG |
| 106 | TCTGTACGGTGACAAGGCGUNNNACTNNNTGAUAUGAGUGGGCAGGAGGC | 1102 | TGACAAGGCGTAGTCACGGUNNNACTNNNTGAUCCCAUGGCAAACACCAUGA |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 107 | TCTGTACGGTGACAAGGCGUNNNACTNNNTGAUCCAGUGGAGGCCGGAUG | 1103 | TGACAAGGCGTAGTCACGGUNNNACTNNNTGAUACUCCUGAACCCUGAAGGC |
| 108 | TCTGTACGGTGACAAGGCGUNNNACTNNNTGAUCCCUCGGGCAGUGACAC | 1104 | TGACAAGGCGTAGTCACGGUNNNACTNNNTGAUCUCCCCUUCUCUGCCCAGA |
| 109 | TCTGTACGGTGACAAGGCGUNNNACTNNNTGAUGAGCCGUGCAGCGAUUG | 1105 | TGACAAGGCGTAGTCACGGUNNNACTNNNTGAUGUUGCCCUUGGAGGCAUAC |
| 110 | TCTGTACGGTGACAAGGCGUNNNACTNNNTGAUGCCCACUGUGCUUCCUC | 1106 | TGACAAGGCGTAGTCACGGUNNNACTNNNTGAUAUUGCAGGCUCACCCCAAT |
| 111 | TCTGTACGGTGACAAGGCGUNNNACTNNNTGAUCGUUCGCGCACACCCUA | 1107 | TGACAAGGCGTAGTCACGGUNNNACTNNNTGAUAAUGCACCAGUGGUGGUCT |
| 112 | TCTGTACGGTGACAAGGCGUNNNACTNNNTGAUCUGCGUCUGCUGUUGCT | 1108 | TGACAAGGCGTAGTCACGGUNNNACTNNNTGAUGAAUCUGUCUGCUGUCCUGT |
| 113 | TCTGTACGGTGACAAGGCGUNNNACTNNNTGAUCCAACGGCAGCUUCGUG | 1109 | TGACAAGGCGTAGTCACGGUNNNACTNNNTGAUAGAUGCUGCAGAUGCUGCT |
| 114 | TCTGTACGGTGACAAGGCGUNNNACTNNNTGAUUGUGGCCCUGUAGGACCT | 1110 | TGACAAGGCGTAGTCACGGUNNNACTNNNTGAUAGCAACCACUCGAUCCUGT |
| 115 | TCTGTACGGTGACAAGGCGUNNNACTNNNTGAUCGAAUGCGCCCCGGACUT | 1111 | TGACAAGGCGTAGTCACGGUNNNACTNNNTGAUAGCUCCAUCUGCAUGGCUT |
| 116 | TCTGTACGGTGACAAGGCGUNNNACTNNNTGAUGAGCUGGUGGAGGCUGAC | 1112 | TGACAAGGCGTAGTCACGGUNNNACTNNNTGAUAGCUGAGGCCUUGCAGAAC |
| 117 | TCTGTACGGTGACAAGGCGUNNNACTNNNTGAUGCUGCCCGUGAAGUGGAT | 1113 | TGACAAGGCGTAGTCACGGUNNNACTNNNTGAUCAAAGCAGCCCUCUCCCAG |
| 118 | TCTGTACGGTGACAAGGCGUNNNACTNNNTGAUCCUGUCCUCCACAGGCAT | 1114 | TGACAAGGCGTAGTCACGGUNNNACTNNNTGAUCACCAGACACAGCAUCUGC |
| 119 | TCTGTACGGTGACAAGGCGUNNNACTNNNTGAUGUGACCCGGAGCACUUCC | 1115 | TGACAAGGCGTAGTCACGGUNNNACTNNNTGAUCACUCCAGCCGUCUCUUGC |
| 120 | TCTGTACGGTGACAAGGCGUNNNACTNNNTGAUACCUGCAACUGCUUCCCT | 1116 | TGACAAGGCGTAGTCACGGUNNNACTNNNTGAUCAGUGGGCAGGUCCUUCAA |
| 121 | TCTGTACGGTGACAAGGCGUNNNACTNNNTGAUGAGAGUGGGCGAGUUUGC | 1117 | TGACAAGGCGTAGTCACGGUNNNACTNNNTGAUCAUCGGAACCUGCACACAG |
| 122 | TCTGTACGGTGACAAGGCGUNNNACTNNNTGAUUGGCUCCUGACCUGGAGT | 1118 | TGACAAGGCGTAGTCACGGUNNNACTNNNTGAUCCUUGUGGCUUUCAGGGUC |
| 123 | TCTGTACGGTGACAAGGCGUNNNACTNNNTGAUAGGCCCUCCCAGAAGGUC | 1119 | TGACAAGGCGTAGTCACGGUNNNACTNNNTGAUCGAUGUCAUUCGCUGCAGT |
| 124 | TCTGTACGGTGACAAGGCGUNNNACTNNNTGAUCUGCCUGACAUCCACGGT | 1120 | TGACAAGGCGTAGTCACGGUNNNACTNNNTGAUCGCUCCAAAACACGACCUT |
| 125 | TCTGTACGGTGACAAGGCGUNNNACTNNNTGAUGGGCAUGGUCCACCACAG | 1121 | TGACAAGGCGTAGTCACGGUNNNACTNNNTGAUCUGCAGGGCCAUCUUGGAG |
| 126 | TCTGTACGGTGACAAGGCGUNNNACTNNNTGAUCAUGGCACAGCCUCCCUT | 1122 | TGACAAGGCGTAGTCACGGUNNNACTNNNTGAUCUGCCUUGUCCCACAUCAG |
| 127 | TCTGTACGGTGACAAGGCGUNNNACTNNNTGAUACACAGCUGGGCGCUUUG | 1123 | TGACAAGGCGTAGTCACGGUNNNACTNNNTGAUCUUCCCCAUCCAUUUCGGG |
| 128 | TCTGTACGGTGACAAGGCGUNNNACTNNNTGAUUUCAGGCGCCAAGUAGGT | 1124 | TGACAAGGCGTAGTCACGGUNNNACTNNNTGAUGAGUUGAACUGGCGGCCAT |
| 129 | TCTGTACGGTGACAAGGCGUNNNACTNNNTGAUCUCACCAUGCUGCAGCAC | 1125 | TGACAAGGCGTAGTCACGGUNNNACTNNNTGAUGCAGGAGCCAAGGUCAGUG |
| 130 | TCTGTACGGTGACAAGGCGUNNNACTNNNTGAUUAGAUGGACGCACUGGGC | 1126 | TGACAAGGCGTAGTCACGGUNNNACTNNNTGAUGCCACGAGAGUGUGGUGAG |
| 131 | TCTGTACGGTGACAAGGCGUNNNACTNNNTGAUAAAGCCGGCUACGCGCUG | 1127 | TGACAAGGCGTAGTCACGGUNNNACTNNNTGAUGCCACUCCGCAGGAUAAAC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 132 | TCTGTACGGTGACAAGGCGUNNNACTNNNTGAUCCAGCCCCUCCUCAGAUG | 1128 | TGACAAGGCGTAGTCACGGUNNNACTNNNTGAUGGAUCCUUGUCCCCACCAT |
| 133 | TCTGTACGGTGACAAGGCGUNNNACTNNNTGAUUCUGUGACAACGGGCUGC | 1129 | TGACAAGGCGTAGTCACGGUNNNACTNNNTGAUGUCACCCCUUCCUUGGCAC |
| 134 | TCTGTACGGTGACAAGGCGUNNNACTNNNTGAUGUGGACAGCAUCGGGAGC | 1130 | TGACAAGGCGTAGTCACGGUNNNACTNNNTGAUGUCGGGAUGGAGAAAGCGA |
| 135 | TCTGTACGGTGACAAGGCGUNNNACTNNNTGAUGGAACAGGAGCAGCUGCG | 1131 | TGACAAGGCGTAGTCACGGUNNNACTNNNTGAUUCCGGCUGCAAUGAUCAGG |
| 136 | TCTGTACGGTGACAAGGCGUNNNACTNNNTGAUAUCUCCUGUGUGCCCAGA | 1132 | TGACAAGGCGTAGTCACGGUNNNACTNNNTGAUUCCUCAGCUCCCGGUUCUC |
| 137 | TCTGTACGGTGACAAGGCGUNNNACTNNNTGAUCCCCAAGUCCUCCUUGCC | 1133 | TGACAAGGCGTAGTCACGGUNNNACTNNNTGAUUGCUUGGAGUCAGCUGAGG |
| 138 | TCTGTACGGTGACAAGGCGUNNNACTNNNTGAUCACAGACAGGCUGUGUGC | 1134 | TGACAAGGCGTAGTCACGGUNNNACTNNNTGAUUGGGAUCUCCUUGGGUGCC |
| 139 | TCTGTACGGTGACAAGGCGUNNNACTNNNTGAUCUCCUGCCAAGAAGGCCA | 1135 | TGACAAGGCGTAGTCACGGUNNNACTNNNTGAUUGUGUCCACACCUGUGUCC |
| 140 | TCTGTACGGTGACAAGGCGUNNNACTNNNTGAUCCACAAGUCGGACCCCUA | 1136 | TGACAAGGCGTAGTCACGGUNNNACTNNNTGAUUUGAGCGUGUGAAGACUGC |
| 141 | TCTGTACGGTGACAAGGCGUNNNACTNNNTGAUGCGGAUCUGGAGGAGCAG | 1137 | TGACAAGGCGTAGTCACGGUNNNACTNNNTGAUUUGCGCUUCUCCUCCUCCT |
| 142 | TCTGTACGGTGACAAGGCGUNNNACTNNNTGAUGAGUGCGGAAGAUUGCCC | 1138 | TGACAAGGCGTAGTCACGGUNNNACTNNNTGAUCCACAUCCACCGAGGCAUT |
| 143 | TCTGTACGGTGACAAGGCGUNNNACTNNNTGAUUACACGUUCACGGUGCCC | 1139 | TGACAAGGCGTAGTCACGGUNNNACTNNNTGAUAGUCCUUGCGUGCAUUGUC |
| 144 | TCTGTACGGTGACAAGGCGUNNNACTNNNTGAUCUGGAGGAAGCCCAUCGA | 1140 | TGACAAGGCGTAGTCACGGUNNNACTNNNTGAUCAGCGAAUGGGCAGCAUUG |
| 145 | TCTGTACGGTGACAAGGCGUNNNACTNNNTGAUCUGGGCUCUUACCGCAAG | 1141 | TGACAAGGCGTAGTCACGGUNNNACTNNNTGAUGACUCGGCCCUGAGUGAUA |
| 146 | TCTGTACGGTGACAAGGCGUNNNACTNNNTGAUCCCCAAGAGUGCCAAGUG | 1142 | TGACAAGGCGTAGTCACGGUNNNACTNNNTGAUCGGCUUUACCUCCAAUGGUG |
| 147 | TCTGTACGGTGACAAGGCGUNNNACTNNNTGAUUCUCGUCUGUCACCCAGG | 1143 | TGACAAGGCGTAGTCACGGUNNNACTNNNTGAUGAGGAUGAGCCUGACCAGUG |
| 148 | TCTGTACGGTGACAAGGCGUNNNACTNNNTGAUGGACCAGACGGUCUCAGA | 1144 | TGACAAGGCGTAGTCACGGUNNNACTNNNTGAUAAACAGUAGCUUCCCUGGGT |
| 149 | TCTGTACGGTGACAAGGCGUNNNACTNNNTGAUAUCCCCAACCGCACUGAG | 1145 | TGACAAGGCGTAGTCACGGUNNNACTNNNTGAUGUAGCUGACCCUGCCUACCT |
| 150 | TCTGTACGGTGACAAGGCGUNNNACTNNNTGAUAGUGACGGAGGAGCUUGT | 1146 | TGACAAGGCGTAGTCACGGUNNNACTNNNTGAUCUUACCAGGCAAGGCCUUGG |
| 151 | TCTGTACGGTGACAAGGCGUNNNACTNNNTGAUAUGGCACUCAGCAGCAAG | 1147 | TGACAAGGCGTAGTCACGGUNNNACTNNNTGAUAUCAUUUCUGCUGGCGCACA |
| 152 | TCTGTACGGTGACAAGGCGUNNNACTNNNTGAUGUGGUGGCCAUAGGAACG | 1148 | TGACAAGGCGTAGTCACGGUNNNACTNNNTGAUCAUCGUAGACCUGGGUCCCT |
| 153 | TCTGTACGGTGACAAGGCGUNNNACTNNNTGAUUAAAACCCAGUGCGUACGCAT | 1149 | TGACAAGGCGTAGTCACGGUNNNACTNNNTGAUGAGUCCACAGUCUGGAAGCG |
| 154 | TCTGTACGGTGACAAGGCGUNNNACTNNNTGAUCCUGAAGAGCACGCCAUG | 1150 | TGACAAGGCGTAGTCACGGUNNNACTNNNTGAUCGGCCCAACACCUUCAUCAT |
| 155 | TCTGTACGGTGACAAGGCGUNNNACTNNNTGAUCAGCUGCACGUUUCCUCC | 1151 | TGACAAGGCGTAGTCACGGUNNNACTNNNTGAUGUAGAGUGUGCGUGGCUCUC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 156 | TCTGTACGGTGACAAGGCGUNNNACTNNNTGAUAGCACCAGCUCACUGCAC | 1152 | TGACAAGGCGTAGTCACGGUNNNACTNNNTGAUUUGGCUCUGACUGUACCACC |
| 157 | TCTGTACGGTGACAAGGCGUNNNACTNNNTGAUAUCGUGGCCUUGACCUCC | 1153 | TGACAAGGCGTAGTCACGGUNNNACTNNNTGAUUGGCCAUCUACAAGCAGUCA |
| 158 | TCTGTACGGTGACAAGGCGUNNNACTNNNTGAUGCAGCUGGUGGAAGACCT | 1154 | TGACAAGGCGTAGTCACGGUNNNACTNNNTGAUCGCAUCGUGUACUUCCGGAT |
| 159 | TCTGTACGGTGACAAGGCGUNNNACTNNNTGAUGACGACUCCGUGUUUGCC | 1155 | TGACAAGGCGTAGTCACGGUNNNACTNNNTGAUUCCUUCCUGUCCUCCUAGCA |
| 160 | TCTGTACGGTGACAAGGCGUNNNACTNNNTGAUUGCUCACAGUCUCCUGGG | 1156 | TGACAAGGCGTAGTCACGGUNNNACTNNNTGAUAGAAGGCGGGAGACAUAUGG |
| 161 | TCTGTACGGTGACAAGGCGUNNNACTNNNTGAUGCAACCUCCGUGAGGACG | 1157 | TGACAAGGCGTAGTCACGGUNNNACTNNNTGAUAAGCCGAAGGUCACAAAGUC |
| 162 | TCTGTACGGTGACAAGGCGUNNNACTNNNTGAUUGCUGGUGUUGCUGAGGG | 1158 | TGACAAGGCGTAGTCACGGUNNNACTNNNTGAUCAGGUCCUCAAGUCUUCGGG |
| 163 | TCTGTACGGTGACAAGGCGUNNNACTNNNTGAUUGACAGUGCCCAGGGCUC | 1159 | TGACAAGGCGTAGTCACGGUNNNACTNNNTGAUCAGCUGGCCUUACCAUCCUG |
| 164 | TCTGTACGGTGACAAGGCGUNNNACTNNNTGAUGGCCUGCUCUUCCUUGGG | 1160 | TGACAAGGCGTAGTCACGGUNNNACTNNNTGAUACACCUGGCCUUCAUACACC |
| 165 | TCTGTACGGTGACAAGGCGUNNNACTNNNTGAUUUGGGUUUCGAGGCCAAC | 1161 | TGACAAGGCGTAGTCACGGUNNNACTNNNTGAUUUCUUUCUCUUCCGCACCCA |
| 166 | TCTGTACGGTGACAAGGCGUNNNACTNNNTGAUGGGCUUUCCUCCUGCGUC | 1162 | TGACAAGGCGTAGTCACGGUNNNACTNNNTGAUACACCUGGCCUUCAUACACC |
| 167 | TCTGTACGGTGACAAGGCGUNNNACTNNNTGAUUAAUGCUGGGACGCUGCC | 1163 | TGACAAGGCGTAGTCACGGUNNNACTNNNTGAUACCAGGAAGGACUCCACUUC |
| 168 | TCTGTACGGTGACAAGGCGUNNNACTNNNTGAUCUCCACCACCACUUCCCC | 1164 | TGACAAGGCGTAGTCACGGUNNNACTNNNTGAUACCAUGCCAUAGUCCAUGCC |
| 169 | TCTGTACGGTGACAAGGCGUNNNACTNNNTGAUUGGAGAUCCACGCCUACC | 1165 | TGACAAGGCGTAGTCACGGUNNNACTNNNTGAUACGGAGACCACUCUUCACGA |
| 170 | TCTGTACGGTGACAAGGCGUNNNACTNNNTGAUGCGAAGCUUCGAGACCUG | 1166 | TGACAAGGCGTAGTCACGGUNNNACTNNNTGAUAUGAUUUGCAAAGCGCACAC |
| 171 | TCTGTACGGTGACAAGGCGUNNNACTNNNTGAUUUCAGAGGAGGUCGUGGG | 1167 | TGACAAGGCGTAGTCACGGUNNNACTNNNTGAUAUGUCUGUGUGUCCCGUCAA |
| 172 | TCTGTACGGTGACAAGGCGUNNNACTNNNTGAUCUGGCAAGCUCCUUCCUG | 1168 | TGACAAGGCGTAGTCACGGUNNNACTNNNTGAUAUGUUGCACAGCCUCCUUGG |
| 173 | TCTGTACGGTGACAAGGCGUNNNACTNNNTGAUCUGCCGAGAAGCCAGUCA | 1169 | TGACAAGGCGTAGTCACGGUNNNACTNNNTGAUCAAUCGCGGUAGAGGCUGUC |
| 174 | TCTGTACGGTGACAAGGCGUNNNACTNNNTGAUCUGCAACGGAAGCACUGG | 1170 | TGACAAGGCGTAGTCACGGUNNNACTNNNTGAUCAGGUGGAGAAGUUCCUGGT |
| 175 | TCTGTACGGTGACAAGGCGUNNNACTNNNTGAUGUGGAGUGGCAGCAGAAG | 1171 | TGACAAGGCGTAGTCACGGUNNNACTNNNTGAUCCCGUGCCUGUAUUCAAGUG |
| 176 | TCTGTACGGTGACAAGGCGUNNNACTNNNTGAUGCUGGAGGAGCAGCUUGA | 1172 | TGACAAGGCGTAGTCACGGUNNNACTNNNTGAUCCGAGGGAAUUCCCACUUUG |
| 177 | TCTGTACGGTGACAAGGCGUNNNACTNNNTGAUUUCCGAGCCAAUCACGGG | 1173 | TGACAAGGCGTAGTCACGGUNNNACTNNNTGAUCCUGGACAGCUUGUGGGAAG |
| 178 | TCTGTACGGTGACAAGGCGUNNNACTNNNTGAUACAUCUCCUACGCCCUGG | 1174 | TGACAAGGCGTAGTCACGGUNNNACTNNNTGAUCCUUGUCCCUCCUUCAAGGG |
| 179 | TCTGTACGGTGACAAGGCGUNNNACTNNNTGAUACCACCUGCUCCCUUCCAG | 1175 | TGACAAGGCGTAGTCACGGUNNNACTNNNTGAUCGCCCAGAGUGAAGAUCUCC |
| 180 | TCTGTACGGTGACAAGGCGUNNNACTNNNTGAUAGACACGGUGGUACUGGC | 1176 | TGACAAGGCGTAGTCACGGUNNNACTNNNTGAUCUCGUACGGUCAGGUUGACG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 181 | TCTGTACGGTGACAAGGCGUNNNACTNNNTGAUCCGAUUGCAGCUCAUGCT | 1177 | TGACAAGGCGTAGTCACGGUNNNACTNNNTGAUCUGACCUAGUGUGAGGGAGG |
| 182 | TCTGTACGGTGACAAGGCGUNNNACTNNNTGAUCUCUGGAAGCCAAGGCAG | 1178 | TGACAAGGCGTAGTCACGGUNNNACTNNNTGAUCUGGACGUUGAUGCCACUGA |
| 183 | TCTGTACGGTGACAAGGCGUNNNACTNNNTGAUCAUUGGCCAAGGAGUGCC | 1179 | TGACAAGGCGTAGTCACGGUNNNACTNNNTGAUCUUCUUCUCCACCGGGUCUC |
| 184 | TCTGTACGGTGACAAGGCGUNNNACTNNNTGAUUCUGGCGGAGCAGAUGAG | 1180 | TGACAAGGCGTAGTCACGGUNNNACTNNNTGAUGCUCAGCUUGUACUCAGGGC |
| 185 | TCTGTACGGTGACAAGGCGUNNNACTNNNTGAUGAUACCCGGACCCUGGAG | 1181 | TGACAAGGCGTAGTCACGGUNNNACTNNNTGAUGCUCCUUCAGUUGAGGCUGG |
| 186 | TCTGTACGGTGACAAGGCGUNNNACTNNNTGAUGAGAUCGCCGCCCUCAUT | 1182 | TGACAAGGCGTAGTCACGGUNNNACTNNNTGAUGGGUGUUGGAGUUCAUGGAG |
| 187 | TCTGTACGGTGACAAGGCGUNNNACTNNNTGAUCUGCACGCAGCCCAAAUC | 1183 | TGACAAGGCGTAGTCACGGUNNNACTNNNTGAUGGUGACGUUGUGCAAGGAGA |
| 188 | TCTGTACGGTGACAAGGCGUNNNACTNNNTGAUACAUCCUGUUGCACCCCA | 1184 | TGACAAGGCGTAGTCACGGUNNNACTNNNTGAUGGUGCACUUCACAACAGGGT |
| 189 | TCTGTACGGTGACAAGGCGUNNNACTNNNTGAUUCGCCACCUCCAACCAUC | 1185 | TGACAAGGCGTAGTCACGGUNNNACTNNNTGAUGUCAUAGUGGGCUUCAGCCG |
| 190 | TCTGTACGGTGACAAGGCGUNNNACTNNNTGAUAGGUGCGCAAGGUGAAAT | 1186 | TGACAAGGCGTAGTCACGGUNNNACTNNNTGAUGUCUGGACGCCCGAUUCUUC |
| 191 | TCTGTACGGTGACAAGGCGUNNNACTNNNTGAUACUUGCUGGAUGGGCCUG | 1187 | TGACAAGGCGTAGTCACGGUNNNACTNNNTGAUUAUAGGUCCGGUGGACAGGG |
| 192 | TCTGTACGGTGACAAGGCGUNNNACTNNNTGAUCUGAAGGAGGGUCACCGC | 1188 | TGACAAGGCGTAGTCACGGUNNNACTNNNTGAUUCUCAGCUGAGGAGAUGGGT |
| 193 | TCTGTACGGTGACAAGGCGUNNNACTNNNTGAUAGUGUGCCAGUAGCCGUG | 1189 | TGACAAGGCGTAGTCACGGUNNNACTNNNTGAUUCUUGAAGGCAUCCACGGAG |
| 194 | TCTGTACGGTGACAAGGCGUNNNACTNNNTGAUGCAUCUGGAGCUCCGUGA | 1190 | TGACAAGGCGTAGTCACGGUNNNACTNNNTGAUUGCCCAAAGCAACCUUCUCC |
| 195 | TCTGTACGGTGACAAGGCGUNNNACTNNNTGAUAGAGAACGUGGUGGGCAT | 1191 | TGACAAGGCGTAGTCACGGUNNNACTNNNTGAUUGUCUUCAGGCUGAUGUUGC |
| 196 | TCTGTACGGTGACAAGGCGUNNNACTNNNTGAUCUUCUGAAGACCGGCCAC | 1192 | TGACAAGGCGTAGTCACGGUNNNACTNNNTGAUUUCUCGCUUCAGCACGAUGT |
| 197 | TCTGTACGGTGACAAGGCGUNNNACTNNNTGAUCUCCCCAACAGGCAGGUG | 1193 | TGACAAGGCGTAGTCACGGUNNNACTNNNTGAUUUGUUGAGCACAAGGAGCAG |
| 198 | TCTGTACGGTGACAAGGCGUNNNACTNNNTGAUGGGCAUGGAGUACUUGGC | 1194 | TGACAAGGCGTAGTCACGGUNNNACTNNNTGAUUUUCAGCAUCUUCACGGCCA |
| 199 | TCTGTACGGTGACAAGGCGUNNNACTNNNTGAUUUGCAGUGUCAUGGGCAAG | 1195 | TGACAAGGCGTAGTCACGGUNNNACTNNNTGAUACCAUUCUGUUCUCUCUGGCA |
| 200 | TCTGTACGGTGACAAGGCGUNNNACTNNNTGAUAGGUGUCUGUCCUGGGAGT | 1196 | TGACAAGGCGTAGTCACGGUNNNACTNNNTGAUGAAUCCUGCUGCCACACAUUG |
| 201 | TCTGTACGGTGACAAGGCGUNNNACTNNNTGAUUGUGCUUUUAGGGCCCACC | 1197 | TGACAAGGCGTAGTCACGGUNNNACTNNNTGAUCUUGGAGCUGGAGCUCUUGUG |
| 202 | TCTGTACGGTGACAAGGCGUNNNACTNNNTGAUCAAGCCCGCUCAUGAUCAA | 1198 | TGACAAGGCGTAGTCACGGUNNNACTNNNTGAUCAGCAUCCAACAAGGCACUGA |
| 203 | TCTGTACGGTGACAAGGCGUNNNACTNNNTGAUGGGCACUGGGUCAAAGUCT | 1199 | TGACAAGGCGTAGTCACGGUNNNACTNNNTGAUGGAUGCCUGACCAGUUAGAGG |
| 204 | TCTGTACGGTGACAAGGCGUNNNACTNNNTGAUAUCAAGAAUCGCCCGAGCC | 1200 | TGACAAGGCGTAGTCACGGUNNNACTNNNTGAUGGAUGAGGAAGUAGCCUCCCA |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 205 | TCTGTACGGTGACAAGGCGUNNNACTNNNTGAUCUGAUGGGACCCACUCCAT | 1201 | TGACAAGGCGTAGTCACGGUNNNACTNNNTGAUCUUGGGCACUUGCACAGAGAT |
| 206 | TCTGTACGGTGACAAGGCGUNNNACTNNNTGAUCUCCAAAAUGGCCCGAGAC | 1202 | TGACAAGGCGTAGTCACGGUNNNACTNNNTGAUCGUUGAACUCUGACAGCAGGT |
| 207 | TCTGTACGGTGACAAGGCGUNNNACTNNNTGAUCAGCAGGGCUUCUUCAGCA | 1203 | TGACAAGGCGTAGTCACGGUNNNACTNNNTGAUAUUCGGACACACUGGCUGUAC |
| 208 | TCTGTACGGTGACAAGGCGUNNNACTNNNTGAUAGCGGGACAUGGACUCAAC | 1204 | TGACAAGGCGTAGTCACGGUNNNACTNNNTGAUCCCUUCUCUGUCUCCCUUGGA |
| 209 | TCTGTACGGTGACAAGGCGUNNNACTNNNTGAUGCAUGUACUGGUCCCGCAT | 1205 | TGACAAGGCGTAGTCACGGUNNNACTNNNTGAUGUCCCGUGAGCACAAUCUCAA |
| 210 | TCTGTACGGTGACAAGGCGUNNNACTNNNTGAUCGGAAUGCCAACCCAUGGA | 1206 | TGACAAGGCGTAGTCACGGUNNNACTNNNTGAUGCACCUUCAUUGGCUACAAGG |
| 211 | TCTGTACGGTGACAAGGCGUNNNACTNNNTGAUUAGGCGAGGAGCUCCAGUC | 1207 | TGACAAGGCGTAGTCACGGUNNNACTNNNTGAUGUUUUUCCCUCAGGCCCUCAT |
| 212 | TCTGTACGGTGACAAGGCGUNNNACTNNNTGAUGGUGAGGCUCCCCUUUCUT | 1208 | TGACAAGGCGTAGTCACGGUNNNACTNNNTGAUUUCCUACAGUACUCCCCUGCC |
| 213 | TCTGTACGGTGACAAGGCGUNNNACTNNNTGAUCAGCCCCUCUGACGUCCAUC | 1209 | TGACAAGGCGTAGTCACGGUNNNACTNNNTGAUCACUUCUCACACCGCUGUGUT |
| 214 | TCTGTACGGTGACAAGGCGUNNNACTNNNTGAUAGGUGCCCAUCAAGUGGAT | 1210 | TGACAAGGCGTAGTCACGGUNNNACTNNNTGAUCCCAUCACACACCAUAACUCC |
| 215 | TCTGTACGGTGACAAGGCGUNNNACTNNNTGAUUCCUCCAGCUUCUUCUGCA | 1211 | TGACAAGGCGTAGTCACGGUNNNACTNNNTGAUAACCCUCCUGAUGUACACGGT |
| 216 | TCTGTACGGTGACAAGGCGUNNNACTNNNTGAUGCGGGCUUGGUUCUGAUGT | 1212 | TGACAAGGCGTAGTCACGGUNNNACTNNNTGAUCUUGCCUUUCUCCCCAACCAG |
| 217 | TCTGTACGGTGACAAGGCGUNNNACTNNNTGAUCGUCCUGAAGCAGGUCAAC | 1213 | TGACAAGGCGTAGTCACGGUNNNACTNNNTGAUACCUUCAGCACUCUGCUUGUG |
| 218 | TCTGTACGGTGACAAGGCGUNNNACTNNNTGAUGGGUGAGGGUGUCUCUCUG | 1214 | TGACAAGGCGTAGTCACGGUNNNACTNNNTGAUUUCUAUCGGCAAAGCGGUGUT |
| 219 | TCTGTACGGTGACAAGGCGUNNNACTNNNTGAUAGUAAAUACGGGCCCGACG | 1215 | TGACAAGGCGTAGTCACGGUNNNACTNNNTGAUACAUUGGGAGCUGAUGAGGAT |
| 220 | TCTGTACGGTGACAAGGCGUNNNACTNNNTGAUCUUCCCCUCCAUUGUGGGC | 1216 | TGACAAGGCGTAGTCACGGUNNNACTNNNTGAUACUUCCUACAGGAAGCCUCCC |
| 221 | TCTGTACGGTGACAAGGCGUNNNACTNNNTGAUCCAUCCGAAAGCAGUCCAA | 1217 | TGACAAGGCGTAGTCACGGUNNNACTNNNTGAUAGGUGGCACCAAAGCTGTAUT |
| 222 | TCTGTACGGTGACAAGGCGUNNNACTNNNTGAUAGGGCAGGAGUCAAGAUGC | 1218 | TGACAAGGCGTAGTCACGGUNNNACTNNNTGAUAGUCUUCCCCACUUCUGCCUT |
| 223 | TCTGTACGGTGACAAGGCGUNNNACTNNNTGAUAUAUGGGCCCCUGGAUGGAUA | 1219 | TGACAAGGCGTAGTCACGGUNNNACTNNNTGAUAUGCUUUCAGGAGGCAUCCAG |
| 224 | TCTGTACGGTGACAAGGCGUNNNACTNNNTGAUGGUAGCAGCCGUCUGUCUC | 1220 | TGACAAGGCGTAGTCACGGUNNNACTNNNTGAUAUUCCGAUGUCAGCACCAAAG |
| 225 | TCTGTACGGTGACAAGGCGUNNNACTNNNTGAUGUACACACUGCAGCCCAAG | 1221 | TGACAAGGCGTAGTCACGGUNNNACTNNNTGAUCACAGUGAUAGGAGGUGUGGG |
| 226 | TCTGTACGGTGACAAGGCGUNNNACTNNNTGAUCUACUAUCCCUCGGGAGGC | 1222 | TGACAAGGCGTAGTCACGGUNNNACTNNNTGAUCACCGUUCCACCUGAAAGACT |
| 227 | TCTGTACGGTGACAAGGCGUNNNACTNNNTGAUCCUUUAAGGCCCCAGCGUC | 1223 | TGACAAGGCGTAGTCACGGUNNNACTNNNTGAUCCCCUGCUCUUCAAUACAGCC |
| 228 | TCTGTACGGTGACAAGGCGUNNNACTNNNTGAUGACCGGAUUCGCAUGUGUG | 1224 | TGACAAGGCGTAGTCACGGUNNNACTNNNTGAUCCCUCAGCUACCAGGAUGUUT |
| 229 | TCTGTACGGTGACAAGGCGUNNNACTNNNTGAUGUCCAGCUCCUCUGACAGC | 1225 | TGACAAGGCGTAGTCACGGUNNNACTNNNTGAUCCUCUUCGAACCUGUCCAUGA |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 230 | TCTGTACGGTGACAAGGCGUNNNACTNNNTGAUGUCUCCACCCCAGCAAAAC | 1226 | TGACAAGGCGTAGTCACGGUNNNACTNNNTGAUCCUGCUCAGUGUAGCUAGGUT |
| 231 | TCTGTACGGTGACAAGGCGUNNNACTNNNTGAUUCAUUCAUGCCCCUCCUGG | 1227 | TGACAAGGCGTAGTCACGGUNNNACTNNNTGAUCUACACUUGGCUGGGCAAAGA |
| 232 | TCTGTACGGTGACAAGGCGUNNNACTNNNTGAUCUGAAGUGCAAGGCACUGC | 1228 | TGACAAGGCGTAGTCACGGUNNNACTNNNTGAUCUCCAUCCUGAGUCAUGGCUT |
| 233 | TCTGTACGGTGACAAGGCGUNNNACTNNNTGAUCUUCACGUGCAGCACAUGG | 1229 | TGACAAGGCGTAGTCACGGUNNNACTNNNTGAUCUCCCUCUGGAAAUCCUUCCG |
| 234 | TCTGTACGGTGACAAGGCGUNNNACTNNNTGAUGGUUUCACGCCACCAACUT | 1230 | TGACAAGGCGTAGTCACGGUNNNACTNNNTGAUCUCGCUGAGAUUGAACUGGAG |
| 235 | TCTGTACGGTGACAAGGCGUNNNACTNNNTGAUUCUUCUGGGCUGGGUGUGA | 1231 | TGACAAGGCGTAGTCACGGUNNNACTNNNTGAUCUGAGUCCUCCUCACCACUGA |
| 236 | TCTGTACGGTGACAAGGCGUNNNACTNNNTGAUACGCUGGCCUAUAAGGUGC | 1232 | TGACAAGGCGTAGTCACGGUNNNACTNNNTGAUCUUCGCCUAGCUCCCUUUUCA |
| 237 | TCTGTACGGTGACAAGGCGUNNNACTNNNTGAUCUUGACCUCCCAGACCGAG | 1233 | TGACAAGGCGTAGTCACGGUNNNACTNNNTGAUGAAGACAUGAGCUCGAGUGCT |
| 238 | TCTGTACGGTGACAAGGCGUNNNACTNNNTGAUUUGGGCAUCACUGUCCUCG | 1234 | TGACAAGGCGTAGTCACGGUNNNACTNNNTGAUGAAUAUGUGGAAGCCCACAGC |
| 239 | TCTGTACGGTGACAAGGCGUNNNACTNNNTGAUAGCUUGAGCAGCAGCUGAG | 1235 | TGACAAGGCGTAGTCACGGUNNNACTNNNTGAUGCAGCAAGUCCAACUGCUAUG |
| 240 | TCTGTACGGTGACAAGGCGUNNNACTNNNTGAUAACAGCUCUCUGUGAUGCG | 1236 | TGACAAGGCGTAGTCACGGUNNNACTNNNTGAUGCAGGCUGGACGUACAUUCUT |
| 241 | TCTGTACGGTGACAAGGCGUNNNACTNNNTGAUACGACGGGAGGACAAUCUC | 1237 | TGACAAGGCGTAGTCACGGUNNNACTNNNTGAUGCAGUGAUGCCUACCAACUGT |
| 242 | TCTGTACGGTGACAAGGCGUNNNACTNNNTGAUCGGCUGCAGGACUAUGAGG | 1238 | TGACAAGGCGTAGTCACGGUNNNACTNNNTGAUGGAAUACUCCAGCUCACAGGG |
| 243 | TCTGTACGGTGACAAGGCGUNNNACTNNNTGAUACCUUGAGCAUCGCAUCCA | 1239 | TGACAAGGCGTAGTCACGGUNNNACTNNNTGAUGGAGCUUGCUCAGCUUGUACT |
| 244 | TCTGTACGGTGACAAGGCGUNNNACTNNNTGAUGAGGGACGUGAACGGAGUG | 1240 | TGACAAGGCGTAGTCACGGUNNNACTNNNTGAUGGGUAGCAGACAAACCUGUGG |
| 245 | TCTGTACGGTGACAAGGCGUNNNACTNNNTGAUACACCCCAGCUCCAGCUC | 1241 | TGACAAGGCGTAGTCACGGUNNNACTNNNTGAUUUUUCCAGGAGAGAGACTCCAGA |
| 246 | TCTGTACGGTGACAAGGCGUNNNACTNNNTGAUGCCUUUCGAGCAGUACUCC | 1242 | TGACAAGGCGTAGTCACGGUNNNACTNNNTGAUGGUGUCUUCAUCCUCGAUGGT |
| 247 | TCTGTACGGTGACAAGGCGUNNNACTNNNTGAUCACAGUACCCGGCUGUAGA | 1243 | TGACAAGGCGTAGTCACGGUNNNACTNNNTGAUGUGAUCCUUGCCAGGUAAUCC |
| 248 | TCTGTACGGTGACAAGGCGUNNNACTNNNTGAUGUGGCCAUAAAGGGCAACC | 1244 | TGACAAGGCGTAGTCACGGUNNNACTNNNTGAUGUGGUUCGUGGCUCUCUUAUC |
| 249 | TCTGTACGGTGACAAGGCGUNNNACTNNNTGAUGUCAGCCCAGACCAUUCAG | 1245 | TGACAAGGCGTAGTCACGGUNNNACTNNNTGAUUCCCAAAUUCUGCCAGGAAGC |
| 250 | TCTGTACGGTGACAAGGCGUNNNACTNNNTGAUUGCUCAGGCUACAUCUCGC | 1246 | TGACAAGGCGTAGTCACGGUNNNACTNNNTGAUUCCUUCUCCAAGGCCAGAAUC |
| 251 | TCTGTACGGTGACAAGGCGUNNNACTNNNTGAUCUGGACCACGGCAAAGAUG | 1247 | TGACAAGGCGTAGTCACGGUNNNACTNNNTGAUUCUCCACUAGCACCAAGGACA |
| 252 | TCTGTACGGTGACAAGGCGUNNNACTNNNTGAUCAGUGGACGUGGAUUUGGG | 1248 | TGACAAGGCGTAGTCACGGUNNNACTNNNTGAUUGGCCAAGCAAUCUGCGUAUT |
| 253 | TCTGTACGGTGACAAGGCGUNNNACTNNNTGAUGCAUCACAGAGCGAAGCUG | 1249 | TGACAAGGCGTAGTCACGGUNNNACTNNNTGAUUAACGCCUGUUUUCUUUCUGCC |
| 254 | TCTGTACGGTGACAAGGCGUNNNACTNNNTGAUAGUGUUGUGAUCCGCCACT | 1250 | TGACAAGGCGTAGTCACGGUNNNACTNNNTGAUCUGGCCAAGAGUUACGGGAUUC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 255 | TCTGTACGGTGACAAGGCGUNNNACTNNNTGAUUUCUGGGACUCAUGCCCT | 1251 | TGACAAGGCGTAGTCACGGUNNNACTNNNTGAUAGGAGUGUGUACUCUUGCAUCG |
| 256 | TCTGTACGGTGACAAGGCGUNNNACTNNNTGAUACCGCGACGACAAGAUCUG | 1252 | TGACAAGGCGTAGTCACGGUNNNACTNNNTGAUGGGACAUUCACCACAUCGACUA |
| 257 | TCTGTACGGTGACAAGGCGUNNNACTNNNTGAUCUUCUACAGCCCAGCCCAG | 1253 | TGACAAGGCGTAGTCACGGUNNNACTNNNTGAUCUCUGAAUCUCUGUGCCCUCAG |
| 258 | TCTGTACGGTGACAAGGCGUNNNACTNNNTGAUGUGGCCAACAUUCAGCAGC | 1254 | TGACAAGGCGTAGTCACGGUNNNACTNNNTGAUCCUUCCUGGUUGGCCGUUAUAT |
| 259 | TCTGTACGGTGACAAGGCGUNNNACTNNNTGAUUGGUUCUCUCCAUCGCCUT | 1255 | TGACAAGGCGTAGTCACGGUNNNACTNNNTGAUUGAACUGCUAGCCUCUGGAUUT |
| 260 | TCTGTACGGTGACAAGGCGUNNNACTNNNTGAUUCAGCUGCUUCCGUUGCUC | 1256 | TGACAAGGCGTAGTCACGGUNNNACTNNNTGAUGACUUGGUGUCAUGCACCUACC |
| 261 | TCTGTACGGTGACAAGGCGUNNNACTNNNTGAUAUUCCGAGGCUGGAAUGGA | 1257 | TGACAAGGCGTAGTCACGGUNNNACTNNNTGAUGAAGGGAGUCACUCUGGUUUGG |
| 262 | TCTGTACGGTGACAAGGCGUNNNACTNNNTGAUCCUCAGAAGUCCAGCAGGC | 1258 | TGACAAGGCGTAGTCACGGUNNNACTNNNTGAUCUGAAAUUGGUGUCGGUGCCUA |
| 263 | TCTGTACGGTGACAAGGCGUNNNACTNNNTGAUCAGGCUGUCAGAGCAGGAG | 1259 | TGACAAGGCGTAGTCACGGUNNNACTNNNTGAUAGAUACUGAUCUCGCCAUCGCT |
| 264 | TCTGTACGGTGACAAGGCGUNNNACTNNNTGAUCUGACGAGAUCGCCAACAG | 1260 | TGACAAGGCGTAGTCACGGUNNNACTNNNTGAUCUGGUUGGAGCGAAUCUGCUAG |
| 265 | TCTGTACGGTGACAAGGCGUNNNACTNNNTGAUCUGGAGGAAGCCAUGGAGC | 1261 | TGACAAGGCGTAGTCACGGUNNNACTNNNTGAUGAACAUGUGUGAGCACAGCAAC |
| 266 | TCTGTACGGTGACAAGGCGUNNNACTNNNTGAUUUCUGAUGGCUUGAAGGCG | 1262 | TGACAAGGCGTAGTCACGGUNNNACTNNNTGAUUGCCUCUUGCUUCUCUUUUCCT |
| 267 | TCTGTACGGTGACAAGGCGUNNNACTNNNTGAUAGGUGUUUGCUGACGUCCA | 1263 | TGACAAGGCGTAGTCACGGUNNNACTNNNTGAUGUUCUCCAGGUCGAAAGGGUAC |
| 268 | TCTGTACGGTGACAAGGCGUNNNACTNNNTGAUGUACAACCAGCCCUCCGAC | 1264 | TGACAAGGCGTAGTCACGGUNNNACTNNNTGAUCUGGAUCCUCAGGACUCUGUCT |
| 269 | TCTGTACGGTGACAAGGCGUNNNACTNNNTGAUGAGCCAGAGUCCGUCAUCG | 1265 | TGACAAGGCGTAGTCACGGUNNNACTNNNTGAUCGUUGAAGCACUGGAUCCACUT |
| 270 | TCTGTACGGTGACAAGGCGUNNNACTNNNTGAUCCUGGUACCAGCUCUCCAA | 1266 | TGACAAGGCGTAGTCACGGUNNNACTNNNTGAUCCACAUCCUCUUCCUCAGGAUT |
| 271 | TCTGTACGGTGACAAGGCGUNNNACTNNNTGAUCCACCUUACUGCCCAGGUG | 1267 | TGACAAGGCGTAGTCACGGUNNNACTNNNTGAUAACGACCAAGUCACCAAGGAUG |
| 272 | TCTGTACGGTGACAAGGCGUNNNACTNNNTGAUCACCCGCCAGCAUCCUUAG | 1268 | TGACAAGGCGTAGTCACGGUNNNACTNNNTGAUCAGAGUUCAUGGAUGCACUGGA |
| 273 | TCTGTACGGTGACAAGGCGUNNNACTNNNTGAUCUGGACUGCUCAGGGUGCC | 1269 | TGACAAGGCGTAGTCACGGUNNNACTNNNTGAUUACUCCACAGUGAGCUCGAUCC |
| 274 | TCTGTACGGTGACAAGGCGUNNNACTNNNTGAUAGCCUGUCAUGAGACCUCC | 1270 | TGACAAGGCGTAGTCACGGUNNNACTNNNTGAUACAAGGCUGUUUGGAGAUGGA |
| 275 | TCTGTACGGTGACAAGGCGUNNNACTNNNTGAUCGCUCUUUCCAGCUGGCUA | 1271 | TGACAAGGCGTAGTCACGGUNNNACTNNNTGAUACAGCAUACAUGCAUUCCUCAG |
| 276 | TCTGTACGGTGACAAGGCGUNNNACTNNNTGAUAACGAGGUUCGGUGUGUC | 1272 | TGACAAGGCGTAGTCACGGUNNNACTNNNTGAUACCAUCGGUGUCAUCCUCAUCA |
| 277 | TCTGTACGGTGACAAGGCGUNNNACTNNNTGAUGCUCCCAGGACCUCCACUA | 1273 | TGACAAGGCGTAGTCACGGUNNNACTNNNTGAUAGACUGUCUCGGACUGUAACUC |
| 278 | TCTGTACGGTGACAAGGCGUNNNACTNNNTGAUGCGACACACUGUAGGCAGT | 1274 | TGACAAGGCGTAGTCACGGUNNNACTNNNTGAUCAAACACUGCCGAGGUGAUUUT |
| 279 | TCTGTACGGTGACAAGGCGUNNNACTNNNTGAUACCUGGGAACCUACUGUGG | 1275 | TGACAAGGCGTAGTCACGGUNNNACTNNNTGAUCAUCAUUGCUGAUAACGGAGGC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 280 | TCTGTACGGTGACAAGGCGUNNNACTNNNTGAUCCUGAAGCUGGACUACCGC | 1276 | TGACAAGGCGTAGTCACGGUNNNACTNNNTGAUCCCAGAGCAAGGAAGUGUUAUC |
| 281 | TCTGTACGGTGACAAGGCGUNNNACTNNNTGAUUGUGGACCUCAGCAGCAUT | 1277 | TGACAAGGCGTAGTCACGGUNNNACTNNNTGAUCCUCCCUCAGGACUGUAACAGA |
| 282 | TCTGTACGGTGACAAGGCGUNNNACTNNNTGAUCCCGUGGCUAUGCCUUCAT | 1278 | TGACAAGGCGTAGTCACGGUNNNACTNNNTGAUCGAGCCCCCUAAAGUGAAGAUC |
| 283 | TCTGTACGGTGACAAGGCGUNNNACTNNNTGAUACAGGGAUUCCUCUUCCCC | 1279 | TGACAAGGCGTAGTCACGGUNNNACTNNNTGAUCGCUUCCUUCAGGGUCUUCAUC |
| 284 | TCTGTACGGTGACAAGGCGUNNNACTNNNTGAUAUGGCACGGAACUGAACCA | 1280 | TGACAAGGCGTAGTCACGGUNNNACTNNNTGAUCUUUCAAUGUUGCCACCACACT |
| 285 | TCTGTACGGTGACAAGGCGUNNNACTNNNTGAUCCUGGAGAACCAGGACCUT | 1281 | TGACAAGGCGTAGTCACGGUNNNACTNNNTGAUGACCUUGGCUGCAUGAAGUUUT |
| 286 | TCTGTACGGTGACAAGGCGUNNNACTNNNTGAUUUUGACCGCAAGCUCCUCC | 1282 | TGACAAGGCGTAGTCACGGUNNNACTNNNTGAUGAGCUUCCCUCUGGAUCUCUCA |
| 287 | TCTGTACGGTGACAAGGCGUNNNACTNNNTGAUGCCUUGCAAGCUGGUCAUT | 1283 | TGACAAGGCGTAGTCACGGUNNNACTNNNTGAUGCAUCGUUUGUGGUUAGUGUCA |
| 288 | TCTGTACGGTGACAAGGCGUNNNACTNNNTGAUGCUGGGACUCGUACGAGAA | 1284 | TGACAAGGCGTAGTCACGGUNNNACTNNNTGAUGCCGTCTUCCTCCATCTCAUAG |
| 289 | TCTGTACGGTGACAAGGCGUNNNACTNNNTGAUCUGGCAUGACAUGCAGACT | 1285 | TGACAAGGCGTAGTCACGGUNNNACTNNNTGAUGGCUAUCUCCAGGUAGUCUGGG |
| 290 | TCTGTACGGTGACAAGGCGUNNNACTNNNTGAUGGCCCUUAGAGAGCUUGGG | 1286 | TGACAAGGCGTAGTCACGGUNNNACTNNNTGAUGGGUGCUGUAUUCUGCAGGAUC |
| 291 | TCTGTACGGTGACAAGGCGUNNNACTNNNTGAUCGCAUACCCGCCAUCUUCT | 1287 | TGACAAGGCGTAGTCACGGUNNNACTNNNTGAUGGGUUGUAGUCGGUCAUGAUGG |
| 292 | TCTGTACGGTGACAAGGCGUNNNACTNNNTGAUCUGCGGAUACAAAGGCGAC | 1288 | TGACAAGGCGTAGTCACGGUNNNACTNNNTGAUGGUGGUGUUCAAAGAACUUGGA |
| 293 | TCTGTACGGTGACAAGGCGUNNNACTNNNTGAUAAAGCUGUGGCUGGAAACA | 1289 | TGACAAGGCGTAGTCACGGUNNNACTNNNTGAUUCCUCCACAGUGAGGUUAGGUG |
| 294 | TCTGTACGGTGACAAGGCGUNNNACTNNNTGAUACAUCUGCUCCGGCUUAGC | 1290 | TGACAAGGCGTAGTCACGGUNNNACTNNNTGAUUGAAGAUGACUUCCUUUCUCGC |
| 295 | TCTGTACGGTGACAAGGCGUNNNACTNNNTGAUGCGACGACUUUAUCUGGGC | 1291 | TGACAAGGCGTAGTCACGGUNNNACTNNNTGAUUUCACCAGCGUCAAGUUGAUGG |
| 296 | TCTGTACGGTGACAAGGCGUNNNACTNNNTGAUCAGUGACUGCUGCCACAAC | 1292 | TGACAAGGCGTAGTCACGGUNNNACTNNNTGAUUUUCUGGCAUUGAUCUCGGCUT |
| 297 | TCTGTACGGTGACAAGGCGUNNNACTNNNTGAUGCUGUACAUCCUGGUUGGG | 1293 | TGACAAGGCGTAGTCACGGUNNNACTNNNTGAUAUCUUCAUCACGUUGUCCUCGG |
| 298 | TCTGTACGGTGACAAGGCGUNNNACTNNNTGAUCAAACCCAACCGUGUGACC | 1294 | TGACAAGGCGTAGTCACGGUNNNACTNNNTGAUCACAAGAACAGUGCAGAGGGUT |
| 299 | TCTGTACGGTGACAAGGCGUNNNACTNNNTGAUGCCAAGCUGUCACCGUAG | 1295 | TGACAAGGCGTAGTCACGGUNNNACTNNNTGAUCUGUUUCUGGGAAACUCCCAUUT |
| 300 | TCTGTACGGTGACAAGGCGUNNNACTNNNTGAUGACGGCACACCCUACGUUA | 1296 | TGACAAGGCGTAGTCACGGUNNNACTNNNTGAUGUGCUGGAAGCCUUUGUCUAUGA |
| 301 | TCTGTACGGTGACAAGGCGUNNNACTNNNTGAUUGAGUGCCACAACCUCCUG | 1297 | TGACAAGGCGTAGTCACGGUNNNACTNNNTGAUUUCCAGACCAGGGUGUUGUUUUC |
| 302 | TCTGTACGGTGACAAGGCGUNNNACTNNNTGAUUGAUGGCUCCCAGCUUCCT | 1298 | TGACAAGGCGTAGTCACGGUNNNACTNNNTGAUACAGCAAAGCAGAAACUCACAUC |
| 303 | TCTGTACGGTGACAAGGCGUNNNACTNNNTGAUGCUGGAUCCUCACAGAGCT | 1299 | TGACAAGGCGTAGTCACGGUNNNACTNNNTGAUUUAGAGGGACUCUUCCCAAUGGA |
| 304 | TCTGTACGGTGACAAGGCGUNNNACTNNNTGAUUGACGAAGUGAGUCCCACA | 1300 | TGACAAGGCGTAGTCACGGUNNNACTNNNTGAUCUGAUAAAGCACCCUCCAUCGUT |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 305 | TCTGTACGGTGACAAGGCGUNNNACTNNNTGAUGAACGGGAAGCCCUCAUGUC | 1301 | TGACAAGGCGTAGTCACGGUNNNACTNNNTGAUAUGACGGAAUAUAAGCUGGUGGT |
| 306 | TCTGTACGGTGACAAGGCGUNNNACTNNNTGAUGGGACUCUGGAUCCCAGAAG | 1302 | TGACAAGGCGTAGTCACGGUNNNACTNNNTGAUCCCAAGCCUGGGACCUCUAUUAT |
| 307 | TCTGTACGGTGACAAGGCGUNNNACTNNNTGAUCCCUCCUUCUGGCCACCAUG | 1303 | TGACAAGGCGTAGTCACGGUNNNACTNNNTGAUCAUCUGCAUGGUACUCUGUCUCG |
| 308 | TCTGTACGGTGACAAGGCGUNNNACTNNNTGAUUGUGCUGGACACGACAACAA | 1304 | TGACAAGGCGTAGTCACGGUNNNACTNNNTGAUCCUCAUUUCUCCUCCAUCCUCAG |
| 309 | TCTGTACGGTGACAAGGCGUNNNACTNNNTGAUAGACCCUGAAGGAUGCCAGT | 1305 | TGACAAGGCGTAGTCACGGUNNNACTNNNTGAUCAACCUUGUCCUAACCUCUCUCC |
| 310 | TCTGTACGGTGACAAGGCGUNNNACTNNNTGAUCGAUCGUUUGCAACCUGCUC | 1306 | TGACAAGGCGTAGTCACGGUNNNACTNNNTGAUCUGGUUUACAGAGAAACCCACCA |
| 311 | TCTGTACGGTGACAAGGCGUNNNACTNNNTGAUUGACAGGCUAUGUCCUCGUG | 1307 | TGACAAGGCGTAGTCACGGUNNNACTNNNTGAUACAUCAGAGAAAGGGACCCUAGT |
| 312 | TCTGTACGGTGACAAGGCGUNNNACTNNNTGAUGGCACAAGAGGCCCUAGAUT | 1308 | TGACAAGGCGTAGTCACGGUNNNACTNNNTGAUGUUGCCACUUUCUCAACUUUCCC |
| 313 | TCTGTACGGTGACAAGGCGUNNNACTNNNTGAUAGCUACCUGACCGACGUUGA | 1309 | TGACAAGGCGTAGTCACGGUNNNACTNNNTGAUUUUUUCCUCUCACUGGCUUCUCC |
| 314 | TCTGTACGGTGACAAGGCGUNNNACTNNNTGAUGGGACCAGCUCUUUCGGAAC | 1310 | TGACAAGGCGTAGTCACGGUNNNACTNNNTGAUACUGCUGUUCCUUCAUACACUUC |
| 315 | TCTGTACGGTGACAAGGCGUNNNACTNNNTGAUGGUGAAGGUGCUUGGAUCUG | 1311 | TGACAAGGCGTAGTCACGGUNNNACTNNNTGAUAUACCCCAGCUCAGAUCUUCUCC |
| 316 | TCTGTACGGTGACAAGGCGUNNNACTNNNTGAUUCUUCAGCAGGAAGUACCGT | 1312 | TGACAAGGCGTAGTCACGGUNNNACTNNNTGAUGCAUGUUUGUUGGUGAUUCCAAG |
| 317 | TCTGTACGGTGACAAGGCGUNNNACTNNNTGAUCUGAGGUGGAAGAGACAGGC | 1313 | TGACAAGGCGTAGTCACGGUNNNACTNNNTGAUAAAUGUGUAAAUUGCCGAGCACG |
| 318 | TCTGTACGGTGACAAGGCGUNNNACTNNNTGAUUGGAGGAGCUCUUCAAGCUG | 1314 | TGACAAGGCGTAGTCACGGUNNNACTNNNTGAUAAUGCUUAUUCAUGGCAGGACCA |
| 319 | TCTGTACGGTGACAAGGCGUNNNACTNNNTGAUGAAGACCCAAGCUGCCUGAC | 1315 | TGACAAGGCGTAGTCACGGUNNNACTNNNTGAUAGAUGAUGAUCUCCAGGUACAGG |
| 320 | TCTGTACGGTGACAAGGCGUNNNACTNNNTGAUGGCUGUUGUGAAAAGGACGG | 1316 | TGACAAGGCGTAGTCACGGUNNNACTNNNTGAUAGGUCUGUCCUCAAGGAAUGGAT |
| 321 | TCTGTACGGTGACAAGGCGUNNNACTNNNTGAUUGUGCUACAUACGGGCUGAA | 1317 | TGACAAGGCGTAGTCACGGUNNNACTNNNTGAUCAUCACCACGAAAUCCUUGGUCT |
| 322 | TCTGTACGGTGACAAGGCGUNNNACTNNNTGAUAGGCCAUUGGCUCUAUGGAA | 1318 | TGACAAGGCGTAGTCACGGUNNNACTNNNTGAUCAUCAGGAGUCUGUUGGACCUUG |
| 323 | TCTGTACGGTGACAAGGCGUNNNACTNNNTGAUGAGGCUAUCACAAGCUGCAC | 1319 | TGACAAGGCGTAGTCACGGUNNNACTNNNTGAUCCAAACUGCUCCAGGUAAUCCAC |
| 324 | TCTGTACGGTGACAAGGCGUNNNACTNNNTGAUCCAUGUCUGGCUGUGAUGCT | 1320 | TGACAAGGCGTAGTCACGGUNNNACTNNNTGAUCCAUCCUUCAUAGCUGUAUGCAC |
| 325 | TCTGTACGGTGACAAGGCGUNNNACTNNNTGAUAUGACGUACCAAACAGGCAC | 1321 | TGACAAGGCGTAGTCACGGUNNNACTNNNTGAUCCCAAGAAAUCGAACUCCACAAG |
| 326 | TCTGTACGGTGACAAGGCGUNNNACTNNNTGAUUCCGGUUCCCACUGAUGACA | 1322 | TGACAAGGCGTAGTCACGGUNNNACTNNNTGAUCCUCUUUGAGGUCUUGUCCAGUC |
| 327 | TCTGTACGGTGACAAGGCGUNNNACTNNNTGAUGUCAUUCAGCACCAGAGGCA | 1323 | TGACAAGGCGTAGTCACGGUNNNACTNNNTGAUCGAUUCCUGGCUUUUCAUCUCUT |
| 328 | TCTGTACGGTGACAAGGCGUNNNACTNNNTGAUGAGCUGCUCAGUUACAGCAG | 1324 | TGACAAGGCGTAGTCACGGUNNNACTNNNTGAUCUGACACCAGAUCAGAAAGGUCT |
| 329 | TCTGTACGGTGACAAGGCGUNNNACTNNNTGAUGAAAUCUCUGGCCAACUCCG | 1325 | TGACAAGGCGTAGTCACGGUNNNACTNNNTGAUCUGAGGAUUUCCAGCAAAUAGGG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 330 | TCTGTACGGTGACAAGGCGUNNNACTNNNTGAUCCAUGCAGAAUGCCACCAAG | 1326 | TGACAAGGCGTAGTCACGGUNNNACTNNNTGAUGGUGAACUCCUGCAUGUCAUCAG |
| 331 | TCTGTACGGTGACAAGGCGUNNNACTNNNTGAUGCACUCCUUGGAGCAAAAGC | 1327 | TGACAAGGCGTAGTCACGGUNNNACTNNNTGAUGUAACAAUACCAGUGAAGACCCG |
| 332 | TCTGTACGGTGACAAGGCGUNNNACTNNNTGAUCUUGUUGGCCUGGCAGAAAA | 1328 | TGACAAGGCGTAGTCACGGUNNNACTNNNTGAUGUAGUAGUGGUUGUGGCACUUGG |
| 333 | TCTGTACGGTGACAAGGCGUNNNACTNNNTGAUGAGAAGGAGAUUGCCCUGCT | 1329 | TGACAAGGCGTAGTCACGGUNNNACTNNNTGAUGUCACAUUCAGGAUGUGCUUUCG |
| 334 | TCTGTACGGTGACAAGGCGUNNNACTNNNTGAUGUCACAGUUUGAGGCACAGG | 1330 | TGACAAGGCGTAGTCACGGUNNNACTNNNTGAUGUUCCUCAGAUCAUUCUCCAGCT |
| 335 | TCTGTACGGTGACAAGGCGUNNNACTNNNTGAUCCCUCUCAUUGACCGGAACC | 1331 | TGACAAGGCGTAGTCACGGUNNNACTNNNTGAUUACAGCUUCUCCCAGUAAGCAUC |
| 336 | TCTGTACGGTGACAAGGCGUNNNACTNNNTGAUCAGCUCUCAUCGGCCAAUCA | 1332 | TGACAAGGCGTAGTCACGGUNNNACTNNNTGAUUAUGGAGGCCAAUGCUCUCUUCA |
| 337 | TCTGTACGGTGACAAGGCGUNNNACTNNNTGAUCCUUCUGGACCAAGACGACT | 1333 | TGACAAGGCGTAGTCACGGUNNNACTNNNTGAUUCUACAUUUGUAGGUGUGGCUGT |
| 338 | TCTGTACGGTGACAAGGCGUNNNACTNNNTGAUCCCCAUCCAGACCUACUCUG | 1334 | TGACAAGGCGTAGTCACGGUNNNACTNNNTGAUUGACAGGAAGACCUUGAGGUAGA |
| 339 | TCTGTACGGTGACAAGGCGUNNNACTNNNTGAUCCUGCCGCUAAAGAAGGGUC | 1335 | TGACAAGGCGTAGTCACGGUNNNACTNNNTGAUUGGUUGAGGACUGUGAGACAGUT |
| 340 | TCTGTACGGTGACAAGGCGUNNNACTNNNTGAUCUGGCAUCUCUCGCUGGUUT | 1336 | TGACAAGGCGTAGTCACGGUNNNACTNNNTGAUUUAUCCUUAAGGAGCCCUGUGUG |
| 341 | TCTGTACGGTGACAAGGCGUNNNACTNNNTGAUUGGUGUCAUCCAGCCUUAGC | 1337 | TGACAAGGCGTAGTCACGGUNNNACTNNNTGAUUUCAACACAGCUGUUGGUUUCUC |
| 342 | TCTGTACGGTGACAAGGCGUNNNACTNNNTGAUCAUACCAGAGGCAAUCCGCA | 1338 | TGACAAGGCGTAGTCACGGUNNNACTNNNTGAUCAGACGUCACUUUCAAACGUGUAT |
| 343 | TCTGTACGGTGACAAGGCGUNNNACTNNNTGAUCACAGCCGGAGGUCAUACUG | 1339 | TGACAAGGCGTAGTCACGGUNNNACTNNNTGAUUCUCUUGGAAACUCCCAUCUUGAG |
| 344 | TCTGTACGGTGACAAGGCGUNNNACTNNNTGAUCGGAUAGUGGAUCCCAACGG | 1340 | TGACAAGGCGTAGTCACGGUNNNACTNNNTGAUAGUGACAGAAAGGUAAAGAGGAGC |
| 345 | TCTGTACGGTGACAAGGCGUNNNACTNNNTGAUCCAGCAGAGGCAUAAGGUUC | 1341 | TGACAAGGCGTAGTCACGGUNNNACTNNNTGAUUGGAGUUUGUCUGCUGAAUGAACC |
| 346 | TCTGTACGGTGACAAGGCGUNNNACTNNNTGAUGAAAACGCCUGUGUUCCACC | 1342 | TGACAAGGCGTAGTCACGGUNNNACTNNNTGAUGUCCUUCUCUUCCAGAGACUUCAG |
| 347 | TCTGTACGGTGACAAGGCGUNNNACTNNNTGAUUUCCGGCAAAUCACAGAUCG | 1343 | TGACAAGGCGTAGTCACGGUNNNACTNNNTGAUCUGUGCCAGGGACCUUACCUUAUA |
| 348 | TCTGTACGGTGACAAGGCGUNNNACTNNNTGAUGUCUCCGGUGUGGAGUUCUG | 1344 | TGACAAGGCGTAGTCACGGUNNNACTNNNTGAUUUGCCAUCAUUGUCCAACAAAGUC |
| 349 | TCTGTACGGTGACAAGGCGUNNNACTNNNTGAUGGCAACAUUGAAAGCCUCGT | 1345 | TGACAAGGCGTAGTCACGGUNNNACTNNNTGAUUUGUUAACCUUGCAGAAUGGUCGA |
| 350 | TCTGTACGGTGACAAGGCGUNNNACTNNNTGAUCACACAAGGGAGGUCCUCAA | 1346 | TGACAAGGCGTAGTCACGGUNNNACTNNNTGAUUUUUUCAGCAUUAACAUGCGUGCT |
| 351 | TCTGTACGGTGACAAGGCGUNNNACTNNNTGAUGGACGACGAGGAUGAGGAUG | 1347 | TGACAAGGCGTAGTCACGGUNNNACTNNNTGAUGGCCAUGAAUUCGUCAGCUAGUUT |
| 352 | TCTGTACGGTGACAAGGCGUNNNACTNNNTGAUCCGAACAGAAACCCCUCCUC | 1348 | TGACAAGGCGTAGTCACGGUNNNACTNNNTGAUGGUGACUGGAUCCACAACCAAAAT |
| 353 | TCTGTACGGTGACAAGGCGUNNNACTNNNTGAUUCCUGCAUCCAAUGGAUGCT | 1349 | TGACAAGGCGTAGTCACGGUNNNACTNNNTGAUCUUGCAGCCAUGAUCCAAUUCUCA |
| 354 | TCTGTACGGTGACAAGGCGUNNNACTNNNTGAUUGUCUCUUCAUGGCCAGUGC | 1350 | TGACAAGGCGTAGTCACGGUNNNACTNNNTGAUCUCCCAGAAUUACCAAGUGAGUCC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 355 | TCTGTACGGTGACAAGGCGUNNNACTNNNTGAUUGAUGGAGAGGCUGAAGCAG | 1351 | TGACAAGGCGTAGTCACGGUNNNACTNNNTGAUGAAAGAGAAGUGCAUGUGCAAGAC |
| 356 | TCTGTACGGTGACAAGGCGUNNNACTNNNTGAUCGAAGCCAUCAAACAGCUGC | 1352 | TGACAAGGCGTAGTCACGGUNNNACTNNNTGAUGUGCCUUUAAAAAUUUGCCCCGAT |
| 357 | TCTGTACGGTGACAAGGCGUNNNACTNNNTGAUCCUUACAUACCCAGCACCGA | 1353 | TGACAAGGCGTAGTCACGGUNNNACTNNNTGAUAGUGCCACUGGUCUAUAAUCCAGA |
| 358 | TCTGTACGGTGACAAGGCGUNNNACTNNNTGAUACCUUGUGUCAAUGGAGGCA | 1354 | TGACAAGGCGTAGTCACGGUNNNACTNNNTGAUUAAGGCCUGCUGAAAAUGACUGAA |
| 359 | TCTGTACGGTGACAAGGCGUNNNACTNNNTGAUCACAGCAUCAAGGAUGUGCA | 1355 | TGACAAGGCGTAGTCACGGUNNNACTNNNTGAUGAUCAUUGUUCCUUCCCCUCAGAC |
| 360 | TCTGTACGGTGACAAGGCGUNNNACTNNNTGAUCCCAAUACCUGCAGCUUCUG | 1356 | TGACAAGGCGTAGTCACGGUNNNACTNNNTGAUAUCUGAUCCUAAAACCCAGCCUCT |
| 361 | TCTGTACGGTGACAAGGCGUNNNACTNNNTGAUCACUACCAGGAUUGCCAACC | 1357 | TGACAAGGCGTAGTCACGGUNNNACTNNNTGAUUUACAGCCCUGGAUUUGUCAAGUT |
| 362 | TCTGTACGGTGACAAGGCGUNNNACTNNNTGAUGGGAUGGAAACUUUGCUGCT | 1358 | TGACAAGGCGTAGTCACGGUNNNACTNNNTGAUGCCGUUGUACACUCAUCUUCCUAG |
| 363 | TCTGTACGGTGACAAGGCGUNNNACTNNNTGAUUGUUGGAGCCCAUUCAGAGC | 1359 | TGACAAGGCGTAGTCACGGUNNNACTNNNTGAUUGCAGUUGGUGGAACCAUUAACUC |
| 364 | TCTGTACGGTGACAAGGCGUNNNACTNNNTGAUUUCGCUCACCUGGAUGACAA | 1360 | TGACAAGGCGTAGTCACGGUNNNACTNNNTGAUCUUCACCUUUAACACCUCCAGUCC |
| 365 | TCTGTACGGTGACAAGGCGUNNNACTNNNTGAUAUGAGGAGUACGUGGAGGUG | 1361 | TGACAAGGCGTAGTCACGGUNNNACTNNNTGAUAAAAACUAUGAUGGUGACGUGCAG |
| 366 | TCTGTACGGTGACAAGGCGUNNNACTNNNTGAUUCUCUCCUUGGCCUCUCCUG | 1362 | TGACAAGGCGTAGTCACGGUNNNACTNNNTGAUGUGAUGAUUGGGAGAUUCCUGAUG |
| 367 | TCTGTACGGTGACAAGGCGUNNNACTNNNTGAUUGCCCAACACUGUACCUCAG | 1363 | TGACAAGGCGTAGTCACGGUNNNACTNNNTGAUAGACCCAAAGGGCAGUAAGAUAGG |
| 368 | TCTGTACGGTGACAAGGCGUNNNACTNNNTGAUCCGGGCAGGAAUCUGAUGAC | 1364 | TGACAAGGCGTAGTCACGGUNNNACTNNNTGAUAAUAAGGUUCACAUCAGGAAGGGT |
| 369 | TCTGTACGGTGACAAGGCGUNNNACTNNNTGAUGCAGGGCAGCAACAUCUUUG | 1365 | TGACAAGGCGTAGTCACGGUNNNACTNNNTGAUAAUAUGCUCAGACCAGUCAUCUGC |
| 370 | TCTGTACGGTGACAAGGCGUNNNACTNNNTGAUUUCUGCAACAGCAGCACAAA | 1366 | TGACAAGGCGTAGTCACGGUNNNACTNNNTGAUAAUCUCCCAAUCAUCACUCGAGUC |
| 371 | TCTGTACGGTGACAAGGCGUNNNACTNNNTGAUCAGCUGCAAUUCCUCGAACG | 1367 | TGACAAGGCGTAGTCACGGUNNNACTNNNTGAUAGCAUCAAAUUUGCGCUGGAUUUC |
| 372 | TCTGTACGGTGACAAGGCGUNNNACTNNNTGAUCGGCCUCACUAAACUGUUGG | 1368 | TGACAAGGCGTAGTCACGGUNNNACTNNNTGAUCAUCAUCUCCAUCUCAGACACCAG |
| 373 | TCTGTACGGTGACAAGGCGUNNNACTNNNTGAUGUGAAGGAGCUGGAGAAGCA | 1369 | TGACAAGGCGTAGTCACGGUNNNACTNNNTGAUCAUUUUGAGAUGCUUGCAAUUGCC |
| 374 | TCTGTACGGTGACAAGGCGUNNNACTNNNTGAUCUGGAGGAAAAGGUCGCCUC | 1370 | TGACAAGGCGTAGTCACGGUNNNACTNNNTGAUCCCAGGUUUAUUAAAUUUCGCAGC |
| 375 | TCTGTACGGTGACAAGGCGUNNNACTNNNTGAUAAUUUAGAAGGGCUGGUGGC | 1371 | TGACAAGGCGTAGTCACGGUNNNACTNNNTGAUCUCCUUCUCCGCACAUUUUACAAG |
| 376 | TCTGTACGGTGACAAGGCGUNNNACTNNNTGAUCCAAACCCCCUACAGAUGGC | 1372 | TGACAAGGCGTAGTCACGGUNNNACTNNNTGAUCUCUUUGUCGGUGGUAUUAACUCC |
| 377 | TCTGTACGGTGACAAGGCGUNNNACTNNNTGAUCACCAGUGGGAGGGUCUUAT | 1373 | TGACAAGGCGTAGTCACGGUNNNACTNNNTGAUCUGGUCCAACUUCAUUUUCUGAGA |
| 378 | TCTGTACGGTGACAAGGCGUNNNACTNNNTGAUACAUCUGCAACAGCAAGCAC | 1374 | TGACAAGGCGTAGTCACGGUNNNACTNNNTGAUGAGUCCAUUAUGAUGCUCCAGGUG |
| 379 | TCTGTACGGTGACAAGGCGUNNNACTNNNTGAUGUACAAUGUCCUCCUGACAGC | 1375 | TGACAAGGCGTAGTCACGGUNNNACTNNNTGAUGCCAAUUCACUGUGGUUUAAGUGC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 380 | TCTGTACGGTGACAAGGCGUNNNACTNNNTGAUCCUGAAGACAGGCCCAACUT | 1376 | TGACAAGGCGTAGTCACGGUNNNACTNNNTGAUGCCAGAGUCAUAGCUGGAGUAACT |
| 381 | TCTGTACGGTGACAAGGCGUNNNACTNNNTGAUACGAGGCUGCAAGAGAGAUC | 1377 | TGACAAGGCGTAGTCACGGUNNNACTNNNTGAUGGACAUCAGUGGUACUGAGCAAUA |
| 382 | TCTGTACGGTGACAAGGCGUNNNACTNNNTGAUUGGCACCCGAGGCAUUAUUT | 1378 | TGACAAGGCGTAGTCACGGUNNNACTNNNTGAUGGUCUAUUCCUGUUGAAGCAGCAA |
| 383 | TCTGTACGGTGACAAGGCGUNNNACTNNNTGAUGGAGAAUGAGUACGGCAGCA | 1379 | TGACAAGGCGTAGTCACGGUNNNACTNNNTGAUGGUGGCUAAUAGCUUCUUCUGUUC |
| 384 | TCTGTACGGTGACAAGGCGUNNNACTNNNTGAUCGGACUCUCCCAUCACUCUG | 1380 | TGACAAGGCGTAGTCACGGUNNNACTNNNTGAUGUCACAGCUGCAGUUGAAAAAGUT |
| 385 | TCTGTACGGTGACAAGGCGUNNNACTNNNTGAUGCUGCUGAAGGAAGGACACA | 1381 | TGACAAGGCGTAGTCACGGUNNNACTNNNTGAUGUUUUCCUUCCUUUAUCCCAGGUG |
| 386 | TCTGTACGGTGACAAGGCGUNNNACTNNNTGAUGGCAUGAGACUCAGUGCAGA | 1382 | TGACAAGGCGTAGTCACGGUNNNACTNNNTGAUUAGCAGGUCAAAAGUGAACUGAUG |
| 387 | TCTGTACGGTGACAAGGCGUNNNACTNNNTGAUGAGACUCUGCUUCGCUGCAT | 1383 | TGACAAGGCGTAGTCACGGUNNNACTNNNTGAUUAUCUCUUCCAUAGGCUCCUGCUG |
| 388 | TCTGTACGGTGACAAGGCGUNNNACTNNNTGAUCUGGAUAGCCUCCACCACCT | 1384 | TGACAAGGCGTAGTCACGGUNNNACTNNNTGAUUAUGCUAUCUGAGCCGUCUAGACT |
| 389 | TCTGTACGGTGACAAGGCGUNNNACTNNNTGAUGUGUGAAUUAGGGACCGGGA | 1385 | TGACAAGGCGTAGTCACGGUNNNACTNNNTGAUUCAGUCUCCAUGAUAGUGGUCCAG |
| 390 | TCTGTACGGTGACAAGGCGUNNNACTNNNTGAUUCCUCAAGGAGCCCUUUCCA | 1386 | TGACAAGGCGTAGTCACGGUNNNACTNNNTGAUUGGACUUCCAUGUGCAAACACUAC |
| 391 | TCTGTACGGTGACAAGGCGUNNNACTNNNTGAUAACCCCCAGUACUUCCGUCA | 1387 | TGACAAGGCGTAGTCACGGUNNNACTNNNTGAUUGUGCUGUCCAUUUUCACUUUCUG |
| 392 | TCTGTACGGTGACAAGGCGUNNNACTNNNTGAUCGAGUGCUACAACCUCAGCC | 1388 | TGACAAGGCGTAGTCACGGUNNNACTNNNTGAUUUACCAAAAGGCAAAAUCCCACCA |
| 393 | TCTGTACGGTGACAAGGCGUNNNACTNNNTGAUCAUUCAGCCCAGAGCCUUUG | 1389 | TGACAAGGCGTAGTCACGGUNNNACTNNNTGAUUUCACUUCCAAUAUUCUCUGCUGC |
| 394 | TCTGTACGGTGACAAGGCGUNNNACTNNNTGAUCAUCUGAAAGGCAGAGCAGG | 1390 | TGACAAGGCGTAGTCACGGUNNNACTNNNTGAUUUCUGGAUUUCAGCUUUGGAAAGT |
| 395 | TCTGTACGGTGACAAGGCGUNNNACTNNNTGAUUACCUACUCCCUCUCCGUGA | 1391 | TGACAAGGCGTAGTCACGGUNNNACTNNNTGAUUUGCAGAAGGAACACCUAUUCGUT |
| 396 | TCTGTACGGTGACAAGGCGUNNNACTNNNTGAUCCACUGCUGUGUCUGUAAACG | 1392 | TGACAAGGCGTAGTCACGGUNNNACTNNNTGAUGCACACCAGAAAAGUCUUAGUAACC |
| 397 | TCTGTACGGTGACAAGGCGUNNNACTNNNTGAUCUCUCUGCGCAUUCAGGAGUG | 1393 | TGACAAGGCGTAGTCACGGUNNNACTNNNTGAUUGUUUCCAAAUGACAACCAGGACAA |
| 398 | TCTGTACGGTGACAAGGCGUNNNACTNNNTGAUCGUACCAGAUGGAUGUGAACC | 1394 | TGACAAGGCGTAGTCACGGUNNNACTNNNTGAUUCUUUGUGAUCCGACCAUGAGUAAG |
| 399 | TCTGTACGGTGACAAGGCGUNNNACTNNNTGAUUGGGACCUCCGGUCAGAAAAC | 1395 | TGACAAGGCGTAGTCACGGUNNNACTNNNTGAUUGGUGAAACCUGUUUGUUGGACAUA |
| 400 | TCTGTACGGTGACAAGGCGUNNNACTNNNTGAUCCACACGCAACUGUCUAGUGG | 1396 | TGACAAGGCGTAGTCACGGUNNNACTNNNTGAUGCAAAUGUAAUCUACCAGGCUUUGG |
| 401 | TCTGTACGGTGACAAGGCGUNNNACTNNNTGAUCCCUACAGAUUGCGAGAGAGC | 1397 | TGACAAGGCGTAGTCACGGUNNNACTNNNTGAUGAGCCAUAGUGGAGAGCUGUAAAUT |
| 402 | TCTGTACGGTGACAAGGCGUNNNACTNNNTGAUAUUCCUGUGCAUGAAAGCACT | 1398 | TGACAAGGCGTAGTCACGGUNNNACTNNNTGAUACAUGUAUGCCAGCUGUUAGAGAUT |
| 403 | TCTGTACGGTGACAAGGCGUNNNACTNNNTGAUUCCUCUGUCACCAGGACAUUC | 1399 | TGACAAGGCGTAGTCACGGUNNNACTNNNTGAUCACCCCAGCAAAGCAUUUUAAGAUC |
| 404 | TCTGTACGGTGACAAGGCGUNNNACTNNNTGAUGACUUGGCAGCCAGAAACAUC | 1400 | TGACAAGGCGTAGTCACGGUNNNACTNNNTGAUUACAUCAUGAGAGGAAUGCAGGAAT |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 405 | TCTGTACGGTGACAAGGCGUNNNACTNNNTGAUGACCACGUGACCUUGAAGCUC | 1401 | TGACAAGGCGTAGTCACGGUNNNACTNNNTGAUCACUUAAUUUGGAUUGUGGCACAGA |
| 406 | TCTGTACGGTGACAAGGCGUNNNACTNNNTGAUGUCGUGUUCUUCAUUCGGCAC | 1402 | TGACAAGGCGTAGTCACGGUNNNACTNNNTGAUCGGUGUCAGCCUCCACT |
| 407 | TCTGTACGGTGACAAGGCGUNNNACTNNNTGAUUGGUUCUGGAUCAGCUGGAUG | 1403 | TGACAAGGCGTAGTCACGGUNNNACTNNNTGAUACUUUGCGUGGUGUAGAUAUGAUCA |
| 408 | TCTGTACGGTGACAAGGCGUNNNACTNNNTGAUCACACUCUUGAGGGCCACAAA | 1404 | TGACAAGGCGTAGTCACGGUNNNACTNNNTGAUCUCUCCUUCCUCCUGUAGUUUCAGA |
| 409 | TCTGTACGGTGACAAGGCGUNNNACTNNNTGAUGCUCCUCAGGAGUCUCCACAT | 1405 | TGACAAGGCGTAGTCACGGUNNNACTNNNTGAUCUCAGGACUUAGCAAGAAGUUAUGG |
| 410 | TCTGTACGGTGACAAGGCGUNNNACTNNNTGAUGGAUACUUACGCGCCACAGAG | 1406 | TGACAAGGCGTAGTCACGGUNNNACTNNNTGAUUAUCACAGAAUUCCUCCAGGCUUCT |
| 411 | TCTGTACGGTGACAAGGCGUNNNACTNNNTGAUCUUGAUGAGCAGCAGCGAAAG | 1407 | TGACAAGGCGTAGTCACGGUNNNACTNNNTGAUCACGGGAAAGUGGUGAAGAUAUGUG |
| 412 | TCTGTACGGTGACAAGGCGUNNNACTNNNTGAUGUCAAGCCCUCCAACAUCCUA | 1408 | TGACAAGGCGTAGTCACGGUNNNACTNNNTGAUUGUGGGUCCUGAAUUGGAGGAAUAT |
| 413 | TCTGTACGGTGACAAGGCGUNNNACTNNNTGAUACUGACAACCACCCUUAACCC | 1409 | TGACAAGGCGTAGTCACGGUNNNACTNNNTGAUCACCUGGAACUUGGUCUCAAAGAUT |
| 414 | TCTGTACGGTGACAAGGCGUNNNACTNNNTGAUUACCCUCUCAGCGUACCCUUG | 1410 | TGACAAGGCGTAGTCACGGUNNNACTNNNTGAUAACCAUAUCAAAUUCACACACUGGC |
| 415 | TCTGTACGGTGACAAGGCGUNNNACTNNNTGAUGUUUGCUGGCUGCAAGAAGAT | 1411 | TGACAAGGCGTAGTCACGGUNNNACTNNNTGAUGCUUUUCCAUCUUUUCUGUGUUGGT |
| 416 | TCTGTACGGTGACAAGGCGUNNNACTNNNTGAUGCACUCACCAUGUGUUCCAUG | 1412 | TGACAAGGCGTAGTCACGGUNNNACTNNNTGAUCCCAGUUGUGGGUACCUUUAGAUUC |
| 417 | TCTGTACGGTGACAAGGCGUNNNACTNNNTGAUUCUCGUACAUGACCACACCCA | 1413 | TGACAAGGCGTAGTCACGGUNNNACTNNNTGAUAAAGAGAUCAUUUGCCCCAUCAAUT |
| 418 | TCTGTACGGTGACAAGGCGUNNNACTNNNTGAUCAACGUUAGGUGGGACAGUAC | 1414 | TGACAAGGCGTAGTCACGGUNNNACTNNNTGAUAAGAUCUAUGUCAUAAAAGCAGGGC |
| 419 | TCTGTACGGTGACAAGGCGUNNNACTNNNTGAUGUCAAGAGGCAGUUUCUGGCA | 1415 | TGACAAGGCGTAGTCACGGUNNNACTNNNTGAUACGGCGAUAUUUUGUCUGAUGUAGG |
| 420 | TCTGTACGGTGACAAGGCGUNNNACTNNNTGAUUGUUAGUCACUGGCAGCAACA | 1416 | TGACAAGGCGTAGTCACGGUNNNACTNNNTGAUACUAUCUGCAGGUUUCAUCUGAAUG |
| 421 | TCTGTACGGTGACAAGGCGUNNNACTNNNTGAUGACAACGUGAUGAAGAUCGCA | 1417 | TGACAAGGCGTAGTCACGGUNNNACTNNNTGAUACUGCAUGCAAUUUCUUUUCCAUCT |
| 422 | TCTGTACGGTGACAAGGCGUNNNACTNNNTGAUCCUCUGCCUCUUCUUCUCCAG | 1418 | TGACAAGGCGTAGTCACGGUNNNACTNNNTGAUAGUUGGUUGAACAGUUAUUUCUGCA |
| 423 | TCTGTACGGTGACAAGGCGUNNNACTNNNTGAUCUCUUUAGCCAUGGCAAGGUC | 1419 | TGACAAGGCGTAGTCACGGUNNNACTNNNTGAUCAAGACCUCUCAGGUAUUGUAAGGG |
| 424 | TCTGTACGGTGACAAGGCGUNNNACTNNNTGAUGUCCACGGAGUGUAUGACCAC | 1420 | TGACAAGGCGTAGTCACGGUNNNACTNNNTGAUCAAGCUCAGAUAUUUGGGCUUCAAG |
| 425 | TCTGTACGGTGACAAGGCGUNNNACTNNNTGAUCCUCAGUCACUGGGAGAAGAA | 1421 | TGACAAGGCGTAGTCACGGUNNNACTNNNTGAUCAGUGCUGUAUCAUCCCAAAUGUCA |
| 426 | TCTGTACGGTGACAAGGCGUNNNACTNNNTGAUCUCCGGCUUUACACCAAAAGC | 1422 | TGACAAGGCGTAGTCACGGUNNNACTNNNTGAUCAUUCAUCAGCUGUGUGUUCUGAAT |
| 427 | TCTGTACGGTGACAAGGCGUNNNACTNNNTGAUCUUCCCUGCACUCUCAUCGCT | 1423 | TGACAAGGCGTAGTCACGGUNNNACTNNNTGAUCCAGUCCCCAGGUAAUGUAAAUGUA |
| 428 | TCTGTACGGTGACAAGGCGUNNNACTNNNTGAUAGAUCCAACCAAUGGUGGACA | 1424 | TGACAAGGCGTAGTCACGGUNNNACTNNNTGAUCCUUCUAGUAAUUUGGGAAUGCCUG |
| 429 | TCTGTACGGTGACAAGGCGUNNNACTNNNTGAUUGUUUAAUAACCCAGCCACGG | 1425 | TGACAAGGCGTAGTCACGGUNNNACTNNNTGAUCUAGGUUUCAUGCUCAUAUCCGGUC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 430 | TCTGTACGGTGACAAGGCGUNNNACTNNNTGAUGAAGUCCUCUCGGAAGGUAGC | 1426 | TGACAAGGCGTAGTCACGGUNNNACTNNNTGAUCUGAUCCUCAGUGGUUUGAACAGUC |
| 431 | TCTGTACGGTGACAAGGCGUNNNACTNNNTGAUUGAAGAAGCAACUGAGAGCUG | 1427 | TGACAAGGCGTAGTCACGGUNNNACTNNNTGAUGAUCGUCUCCUCUGAAAUGUCAUUC |
| 432 | TCTGTACGGTGACAAGGCGUNNNACTNNNTGAUGCAGCUCCCAGAAGUUGACAG | 1428 | TGACAAGGCGTAGTCACGGUNNNACTNNNTGAUGCCAUCUCUUUAUCGGAGUCUCUUT |
| 433 | TCTGTACGGTGACAAGGCGUNNNACTNNNTGAUCUUCAGGCAUUGCUACUCUGG | 1429 | TGACAAGGCGTAGTCACGGUNNNACTNNNTGAUGGAAGUCAAAUAUUUGCCUCUCCAG |
| 434 | TCTGTACGGTGACAAGGCGUNNNACTNNNTGAUCGUAGUAGACAUCACUCGCAC | 1430 | TGACAAGGCGTAGTCACGGUNNNACTNNNTGAUUAAGGCAUUUCGCUCAACACUUUC |
| 435 | TCTGTACGGTGACAAGGCGUNNNACTNNNTGAUGGCAUCUAGUCUUUCCGCUUC | 1431 | TGACAAGGCGTAGTCACGGUNNNACTNNNTGAUUCAUAUGGCUAUCCCUUUGCAAUUC |
| 436 | TCTGTACGGTGACAAGGCGUNNNACTNNNTGAUGUAUGGCACAAUCAGAGCUGT | 1432 | TGACAAGGCGTAGTCACGGUNNNACTNNNTGAUUCCAUACUGCUCAACCUCUGCAAUA |
| 437 | TCTGTACGGTGACAAGGCGUNNNACTNNNTGAUUGAAGAUCAUGUGGCCUCAGT | 1433 | TGACAAGGCGTAGTCACGGUNNNACTNNNTGAUUCCAUUUCUGAGAUCAGGUCUGACA |
| 438 | TCTGTACGGTGACAAGGCGUNNNACTNNNTGAUUUGCUUUGGAGCAGAAGAAGG | 1434 | TGACAAGGCGTAGTCACGGUNNNACTNNNTGAUUCUAGCUGUAGCACAAAAUCUUCGT |
| 439 | TCTGTACGGTGACAAGGCGUNNNACTNNNTGAUAGUUGCAAAGACACAAGUGGG | 1435 | TGACAAGGCGTAGTCACGGUNNNACTNNNTGAUUGACACCAACAUCUUUACUGCAGAA |
| 440 | TCTGTACGGTGACAAGGCGUNNNACTNNNTGAUUUCGGAACCUUUCUUCCCCUG | 1436 | TGACAAGGCGTAGTCACGGUNNNACTNNNTGAUGUUGGAUGAAUGGAGGUGAGGAAUT |
| 441 | TCTGTACGGTGACAAGGCGUNNNACTNNNTGAUCUCAACGAAAAGAGCUACCGC | 1437 | TGACAAGGCGTAGTCACGGUNNNACTNNNTGAUCUUGCGCUUGUUAUACUCUUUAGUGC |
| 442 | TCTGTACGGTGACAAGGCGUNNNACTNNNTGAUACCCUGACUUCCAGAAAACCA | 1438 | TGACAAGGCGTAGTCACGGUNNNACTNNNTGAUAAAAGACUCGGAUGAUGUACCUAUGG |
| 443 | TCTGTACGGTGACAAGGCGUNNNACTNNNTGAUAGCACUGCUCUCAGUGAGAAG | 1439 | TGACAAGGCGTAGTCACGGUNNNACTNNNTGAUCCUGACCCAAGAUGAAAUAAAACGUC |
| 444 | TCTGTACGGTGACAAGGCGUNNNACTNNNTGAUGGAUUAUGGGCAUCCCAGAAG | 1440 | TGACAAGGCGTAGTCACGGUNNNACTNNNTGAUAGAGCCUAAACAUCCCCUUAAAUUGG |
| 445 | TCTGTACGGTGACAAGGCGUNNNACTNNNTGAUGCAAAUAUUGGGCCCUUCCUG | 1441 | TGACAAGGCGTAGTCACGGUNNNACTNNNTGAUGGUGUGAAAUGACUGAGUACAAACUG |
| 446 | TCTGTACGGTGACAAGGCGUNNNACTNNNTGAUAACUGAAGCUGUCAGGACAGA | 1442 | TGACAAGGCGTAGTCACGGUNNNACTNNNTGAUGCUCACAGAAAUGUCUGCUAUACUGA |
| 447 | TCTGTACGGTGACAAGGCGUNNNACTNNNTGAUUGUUGGCUACCUUGGGACAUC | 1443 | TGACAAGGCGTAGTCACGGUNNNACTNNNTGAUAGACUGCUAAGGCAUAGGAAUUUCG |
| 448 | TCTGTACGGTGACAAGGCGUNNNACTNNNTGAUAUGCAUCUCUUGUCGCAGGUT | 1444 | TGACAAGGCGTAGTCACGGUNNNACTNNNTGAUGGUAAUAGUCGGUGCUGUAGAUAUCC |
| 449 | TCTGTACGGTGACAAGGCGUNNNACTNNNTGAUGAACUGUGAGGAUGUGGCUGA | 1445 | TGACAAGGCGTAGTCACGGUNNNACTNNNTGAUGUUCAAAUGAGUAGACACAGCUUGAG |
| 450 | TCTGTACGGTGACAAGGCGUNNNACTNNNTGAUAGUAAUCAAGCAGCAGCCAGA | 1446 | TGACAAGGCGTAGTCACGGUNNNACTNNNTGAUUACCAGAUAGAACAGACACAGCUACT |
| 451 | TCTGTACGGTGACAAGGCGUNNNACTNNNTGAUUAUUGGGACUCCUCUGCCCUG | 1447 | TGACAAGGCGTAGTCACGGUNNNACTNNNTGAUCAAAGAUGCAGAGCUCUGAGUAGAAC |
| 452 | TCTGTACGGTGACAAGGCGUNNNACTNNNTGAUCCAAGCUGGUUUUGAAGUCGC | 1448 | TGACAAGGCGTAGTCACGGUNNNACTNNNTGAUCUGCUUGAAGAUCAGAAGUUCCAAUG |
| 453 | TCTGTACGGTGACAAGGCGUNNNACTNNNTGAUGUCAGAGAGAGCAGCUUUGUG | 1449 | TGACAAGGCGTAGTCACGGUNNNACTNNNTGAUCAUAGGCAAGAAGAUGGAACAGAUGA |
| 454 | TCTGTACGGTGACAAGGCGUNNNACTNNNTGAUGCAUUCAGCUCCUCUGUGUUT | 1450 | TGACAAGGCGTAGTCACGGUNNNACTNNNTGAUAGAUGGAGAUGAUGAAGAUGAUUGGG |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 455 | TCTGTACGGTGACAAGGCGUNNNACTNNNTGAUUGUUGAAGAGAUUGGCUGGUC | 1451 | TGACAAGGCGTAGTCACGGUNNNACTNNNTGAUAAGAGAAAGGAGAUUACAGCUUCCC |
| 456 | TCTGTACGGTGACAAGGCGUNNNACTNNNTGAUUACAACUGCUACCAUGAGGGC | 1452 | TGACAAGGCGTAGTCACGGUNNNACTNNNTGAUAGAAACCUGUCUCUUGGAUAUUCUCG |
| 457 | TCTGTACGGTGACAAGGCGUNNNACTNNNTGAUGUGUGGGAACGUGAAACAUCT | 1453 | TGACAAGGCGTAGTCACGGUNNNACTNNNTGAUCCCAAAUAUCCCCAGUUUCCAGAAUC |
| 458 | TCTGTACGGTGACAAGGCGUNNNACTNNNTGAUGCUCACAUCUUCAGGUGCCUC | 1454 | TGACAAGGCGTAGTCACGGUNNNACTNNNTGAUAUCUACUUCCAUCUUGUCAGGAGGAC |
| 459 | TCTGTACGGTGACAAGGCGUNNNACTNNNTGAUCCAUCUACAAGAAAGCCCCCA | 1455 | TGACAAGGCGTAGTCACGGUNNNACTNNNTGAUGAUCUUCUCAAAGUCGUCAUCCUUCA |
| 460 | TCTGTACGGTGACAAGGCGUNNNACTNNNTGAUCCAGGUACCACCUUAUCCACA | 1456 | TGACAAGGCGTAGTCACGGUNNNACTNNNTGAUCUCACAGAGUUCAAGCUGAAGAAGAT |
| 461 | TCTGTACGGTGACAAGGCGUNNNACTNNNTGAUUACCUGGACAAGCACAUGGAG | 1457 | TGACAAGGCGTAGTCACGGUNNNACTNNNTGAUGCUGAAACAAAAAGCACUCUUCUGUC |
| 462 | TCTGTACGGTGACAAGGCGUNNNACTNNNTGAUACAGUCUCUUGCAAUCGGCUA | 1458 | TGACAAGGCGTAGTCACGGUNNNACTNNNTGAUACAUGAUGGAUGUCACGUUCUCAAAG |
| 463 | TCTGTACGGTGACAAGGCGUNNNACTNNNTGAUGCCCGGGAAUUUCUUCGAAAA | 1459 | TGACAAGGCGTAGTCACGGUNNNACTNNNTGAUCUUGUGAGUGGAUGGGUAAAACCUAT |
| 464 | TCTGTACGGTGACAAGGCGUNNNACTNNNTGAUAACUUCAGUGGGCAUCGAGAT | 1460 | TGACAAGGCGTAGTCACGGUNNNACTNNNTGAUCACAGCAGUCUUUCUUUCCCAUGUAA |
| 465 | TCTGTACGGTGACAAGGCGUNNNACTNNNTGAUUCACAGACUGUUUCCACUCCT | 1461 | TGACAAGGCGTAGTCACGGUNNNACTNNNTGAUAGCCUCUUGCUCAGUUUUAUCUAAGG |
| 466 | TCTGTACGGTGACAAGGCGUNNNACTNNNTGAUAGUAGAGGAUGCCGAGGAGAA | 1462 | TGACAAGGCGTAGTCACGGUNNNACTNNNTGAUUCUCUUUAGGGAGCUUCUCUUCUUCC |
| 467 | TCTGTACGGTGACAAGGCGUNNNACTNNNTGAUCUCCUGUGAUCGCACUGACAC | 1463 | TGACAAGGCGTAGTCACGGUNNNACTNNNTGAUGCCAGAGAAAAGAGAGUUACUCACAC |
| 468 | TCTGTACGGTGACAAGGCGUNNNACTNNNTGAUGUGCAUCCUUGGCAGAAAGUG | 1464 | TGACAAGGCGTAGTCACGGUNNNACTNNNTGAUACACCUUGUCUUGAUUUUACUUUCCC |
| 469 | TCTGTACGGTGACAAGGCGUNNNACTNNNTGAUCAACAACCUGUUGGAGCACAT | 1465 | TGACAAGGCGTAGTCACGGUNNNACTNNNTGAUACUAAUGAAUUCUUCUUCCUGCUCAG |
| 470 | TCTGTACGGTGACAAGGCGUNNNACTNNNTGAUACCAGUGCAAGACUGAGACUC | 1466 | TGACAAGGCGTAGTCACGGUNNNACTNNNTGAUAGUGAUCAGAGGUCUUGACAUAUUGG |
| 471 | TCTGTACGGTGACAAGGCGUNNNACTNNNTGAUUCCUCCAUCAGUGACCUGAAG | 1467 | TGACAAGGCGTAGTCACGGUNNNACTNNNTGAUAUAAAUCAGGGAGUCAGAUGGAGUGG |
| 472 | TCTGTACGGTGACAAGGCGUNNNACTNNNTGAUCAGAGGCCUUCAUGGAAGGAA | 1468 | TGACAAGGCGTAGTCACGGUNNNACTNNNTGAUCACUGACGGAAGUUCUCAUAAACGUC |
| 473 | TCTGTACGGTGACAAGGCGUNNNACTNNNTGAUGUGACUUCCACCAGGACUGUG | 1469 | TGACAAGGCGTAGTCACGGUNNNACTNNNTGAUCACUUUGACCAAAGUCUCACUGACAA |
| 474 | TCTGTACGGTGACAAGGCGUNNNACTNNNTGAUGUGACCAGUGCUACGUUUCCT | 1470 | TGACAAGGCGTAGTCACGGUNNNACTNNNTGAUCAUCUUCAAAGUUGCAGUAAAAACCC |
| 475 | TCTGTACGGTGACAAGGCGUNNNACTNNNTGAUGCCACAUGGCGGAGAGUUUUA | 1471 | TGACAAGGCGTAGTCACGGUNNNACTNNNTGAUCCUUUCACGAAUUCAUUUUCUUUGCG |
| 476 | TCTGTACGGTGACAAGGCGUNNNACTNNNTGAUUACUGUGCCACUUCAGUGUGC | 1472 | TGACAAGGCGTAGTCACGGUNNNACTNNNTGAUCUAUCACAUUGUUCUCUCCAAUGCAG |
| 477 | TCTGTACGGTGACAAGGCGUNNNACTNNNTGAUAGUUCAGUGCCAUCAUCCUGG | 1473 | TGACAAGGCGTAGTCACGGUNNNACTNNNTGAUCUCGUACAAGUCACAAAGUGUAUCCA |
| 478 | TCTGTACGGTGACAAGGCGUNNNACTNNNTGAUAUCCCUUCCACAGACGUCACT | 1474 | TGACAAGGCGTAGTCACGGUNNNACTNNNTGAUGACAGACUUCUCUCACACAUUGUGUC |
| 479 | TCTGTACGGTGACAAGGCGUNNNACTNNNTGAUUAACCGGAGCCUGGACCAUAG | 1475 | TGACAAGGCGTAGTCACGGUNNNACTNNNTGAUGAGAGUGCAGUAUCAAGAAUCUUGUC |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 480 | TCTGTACGGTGACAAGGCGUNNNACTNNNTGAUAACGCUCUGGAGUCUCUCUCC | 1476 | TGACAAGGCGTAGTCACGGUNNNACTNNNTGAUGAGAUAGUUUCACUUUCUUCCCAGCT |
| 481 | TCTGTACGGTGACAAGGCGUNNNACTNNNTGAUGUAGAGCAAAUCCAUCCCCACA | 1477 | TGACAAGGCGTAGTCACGGUNNNACTNNNTGAUGCCAUCUCCUCUUGCAUAAACAAGUT |
| 482 | TCTGTACGGTGACAAGGCGUNNNACTNNNTGAUUCGAGCCACCAAUUUCAUAGGC | 1478 | TGACAAGGCGTAGTCACGGUNNNACTNNNTGAUGGUGGAAAGUAAUAGUCAAUGGGCAA |
| 483 | TCTGTACGGTGACAAGGCGUNNNACTNNNTGAUCUCCCAACCAAGCUCUCUUGAG | 1479 | TGACAAGGCGTAGTCACGGUNNNACTNNNTGAUGUCUUCCCAACAAAUUUUGGGUGAAA |
| 484 | TCTGTACGGTGACAAGGCGUNNNACTNNNTGAUGGGUAUUCGAUGAUCCCUGUGG | 1480 | TGACAAGGCGTAGTCACGGUNNNACTNNNTGAUUCAUCAUCAUCAUCAUCCUCCGA |
| 485 | TCTGTACGGTGACAAGGCGUNNNACTNNNTGAUGUCCCCAAUGACCUGCUGAAAT | 1481 | TGACAAGGCGTAGTCACGGUNNNACTNNNTGAUUGAUGCUUUGUUAAUGCGAAGUUCUG |
| 486 | TCTGTACGGTGACAAGGCGUNNNACTNNNTGAUCAGAAGCAUCUCACCGAAAUCC | 1482 | TGACAAGGCGTAGTCACGGUNNNACTNNNTGAUUGUUGUACACUUUGAGGAGUGAUCUG |
| 487 | TCTGTACGGTGACAAGGCGUNNNACTNNNTGAUCUAUGGUGGUGCCGACUACAAG | 1483 | TGACAAGGCGTAGTCACGGUNNNACTNNNTGAUUUUUGUGAACAGUUCUUCUGGAUCAG |
| 488 | TCTGTACGGTGACAAGGCGUNNNACTNNNTGAUCUUCUACCAGCUCACCAAGCUC | 1484 | TGACAAGGCGTAGTCACGGUNNNACTNNNTGAUAACCAGACAGAAAAUUCCACAUAAGC |
| 489 | TCTGTACGGTGACAAGGCGUNNNACTNNNTGAUCACCCCCACUGAACCUCUCUUA | 1485 | TGACAAGGCGTAGTCACGGUNNNACTNNNTGAUUGGGACACAAUUUGACAAAUAUGACCA |
| 490 | TCTGTACGGTGACAAGGCGUNNNACTNNNTGAUCCAAUCCCCACACCAAGUAUCA | 1486 | TGACAAGGCGTAGTCACGGUNNNACTNNNTGAUUAGCACAGUUUAAAAAUGAGGCCUACT |
| 491 | TCTGTACGGTGACAAGGCGUNNNACTNNNTGAUGAGCCUGAAGAUCCUACCUGAG | 1487 | TGACAAGGCGTAGTCACGGUNNNACTNNNTGAUGAUUCUUAUAAAGUGCAGCUUCUGCAT |
| 492 | TCTGTACGGTGACAAGGCGUNNNACTNNNTGAUCGCAAUCCGGAACCAGAUCAUA | 1488 | TGACAAGGCGTAGTCACGGUNNNACTNNNTGAUUUGUGUGGAAGAUCCAAUCCAUUUUUG |
| 493 | TCTGTACGGTGACAAGGCGUNNNACTNNNTGAUGGACUAGGCGUGGGAUGUUUUT | 1489 | TGACAAGGCGTAGTCACGGUNNNACTNNNTGAUUGAAACUAAAAAUCCUUUGCAGGACUG |
| 494 | TCTGTACGGTGACAAGGCGUNNNACTNNNTGAUACUCCACACGCAAAUUUCCUUC | 1490 | TGACAAGGCGTAGTCACGGUNNNACTNNNTGAUACCAUACUCUACCACAUAUAGGUCCUT |
| 495 | TCTGTACGGTGACAAGGCGUNNNACTNNNTGAUCUGCAGCAAAGACUGGUUCUCA | 1491 | TGACAAGGCGTAGTCACGGUNNNACTNNNTGAUGCUUCUUUGAGUUUGUAUCUUGGAUGC |
| 496 | TCTGTACGGTGACAAGGCGUNNNACTNNNTGAUUGGAAUAACCAGCUGUCCUCCT | 1492 | TGACAAGGCGTAGTCACGGUNNNACTNNNTGAUUGUGGAGUAUUUGGAUGACAGAAACAC |
| 497 | TCTGTACGGTGACAAGGCGUNNNACTNNNTGAUAGGUAUUCUCGGAGGUUGCCUT | 1493 | TGACAAGGCGTAGTCACGGUNNNACTNNNTGAUCAUGAACCGUUCUGAGAUGAAUUAGGA |
| 498 | TCTGTACGGTGACAAGGCGUNNNACTNNNTGAUCCUUCCCUCGGGAAAAACUGAC | 1494 | TGACAAGGCGTAGTCACGGUNNNACTNNNTGAUCUGAUCUACAGAGUUCCAAAAGUGACA |
| 499 | TCTGTACGGTGACAAGGCGUNNNACTNNNTGAUCCCAAGCACAUGGAUCAGUGUT | 1495 | TGACAAGGCGTAGTCACGGUNNNACTNNNTGAUCUUGAUUUCUUUUACUGACCCUUCUGC |
| 500 | TCTGTACGGTGACAAGGCGUNNNACTNNNTGAUAAGUACAAUUGCAGGCUGAACG | 1496 | TGACAAGGCGTAGTCACGGUNNNACTNNNTGAUGAAGAUUUUCAAUCUCCUCUUGGGUUG |
| 501 | TCTGTACGGTGACAAGGCGUNNNACTNNNTGAUUAAGCCCACAUAUCAGGACCGA | 1497 | TGACAAGGCGTAGTCACGGUNNNACTNNNTGAUGAUCUUUGUGCUUACUCCUUCCUAGUT |
| 502 | TCTGTACGGTGACAAGGCGUNNNACTNNNTGAUACACCUGGACACCUUGUUAGAT | 1498 | TGACAAGGCGTAGTCACGGUNNNACTNNNTGAUGGAAAUGUUUCCUAGACAAACUCGUCA |
| 503 | TCTGTACGGTGACAAGGCGUNNNACTNNNTGAUGUCUGGAUCUGCAGCUCUAUGG | 1499 | TGACAAGGCGTAGTCACGGUNNNACTNNNTGAUGUGGAAUGGAAUGGAUUUUGAAGGAG |
| 504 | TCTGTACGGTGACAAGGCGUNNNACTNNNTGAUAGCUACAGAGACACAACCCAUT | 1500 | TGACAAGGCGTAGTCACGGUNNNACTNNNTGAUUGGAAGAUCUUAACUUCCCUUUCAAGA |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 505 | TCTGTACGGTGACAAGGCGUNNNACTNNNTGAUAGAAUCGCAAGAGAAGCACCUT | 1501 | TGACAAGGCGTAGTCACGGUNNNACTNNNTGAUUUCUGGUUGAGAGAUUUGGUAUUUGGT |
| 506 | TCTGTACGGTGACAAGGCGUNNNACTNNNTGAUCCGGCUCUUUCCACUAAACCAG | 1502 | TGACAAGGCGTAGTCACGGUNNNACTNNNTGAUGUGUACGUUUGUCAGUUAUUAUAGUGCC |
| 507 | TCTGTACGGTGACAAGGCGUNNNACTNNNTGAUUGCAGUGUUUAGCAUUCUUGGG | 1503 | TGACAAGGCGTAGTCACGGUNNNACTNNNTGAUAAAAUCUCCAGGCCUAACAUAAUUUCAG |
| 508 | TCTGTACGGTGACAAGGCGUNNNACTNNNTGAUAGCAAAACUACUGUAGAGCCCA | 1504 | TGACAAGGCGTAGTCACGGUNNNACTNNNTGAUACACAUGAAGCCAUCGUAUAUAUUCACA |
| 509 | TCTGTACGGTGACAAGGCGUNNNACTNNNTGAUAUCCUUUUGCUCCUGGUGGAAC | 1505 | TGACAAGGCGTAGTCACGGUNNNACTNNNTGAUCAGCUCAGAAUUAACCAUAAAACUGGUG |
| 510 | TCTGTACGGTGACAAGGCGUNNNACTNNNTGAUGACAUGUUGGAUGUGAAGGAGC | 1506 | TGACAAGGCGTAGTCACGGUNNNACTNNNTGAUUCAUACCUACCUCUGCAAUUAAAUUUGG |
| 511 | TCTGTACGGTGACAAGGCGUNNNACTNNNTGAUCUCCACCAAAGUCACCAGAGGG | 1507 | TGACAAGGCGTAGTCACGGUNNNACTNNNTGAUAUUGAUUGUUUCUAAUAGAGCAGCCAGA |
| 512 | TCTGTACGGTGACAAGGCGUNNNACTNNNTGAUGUCUUAUAGCGGAAGAGGCAGA | 1508 | TGACAAGGCGTAGTCACGGUNNNACTNNNTGAUUGUAGACUUGGAAUCUACUGAUAUCCCT |
| 513 | TCTGTACGGTGACAAGGCGUNNNACTNNNTGAUAGAGCCAUGGACACACUCAAGA | 1509 | TGACAAGGCGTAGTCACGGUNNNACTNNNTGAUAAAUAAAGGACCCAUUAGAACCAACUCC |
| 514 | TCTGTACGGTGACAAGGCGUNNNACTNNNTGAUUCUCUUCUCCAUCGUCCAUGAC | 1510 | TGACAAGGCGTAGTCACGGUNNNACTNNNTGAUUAGAAUGCCAGUUAAUGAAAACAGAACG |
| 515 | TCTGTACGGTGACAAGGCGUNNNACTNNNTGAUGCAGAUUCCUCAUGGUCAUGGG | 1511 | TGACAAGGCGTAGTCACGGUNNNACTNNNTGAUUGAAGACAGAUGGCUCAUUCAUAGGAUA |
| 516 | TCTGTACGGTGACAAGGCGUNNNACTNNNTGAUUGAAGAACUAGUCCAGCUUCGA | 1512 | TGACAAGGCGTAGTCACGGUNNNACTNNNTGAUCAAUUCCUCUUGACUAUUCUACAGCAAA |
| 517 | TCTGTACGGTGACAAGGCGUNNNACTNNNTGAUAACCUGCGCAAACUCUUUGUUC | 1513 | TGACAAGGCGTAGTCACGGUNNNACTNNNTGAUACAAGAAUGAAAAGUCUUCAACACUUGG |
| 518 | TCTGTACGGTGACAAGGCGUNNNACTNNNTGAUUCAAGUUGGUGAAAAGGCUUGG | 1514 | TGACAAGGCGTAGTCACGGUNNNACTNNNTGAUCCAGAAAUGUUUUGGUAACAGAAAACAA |
| 519 | TCTGTACGGTGACAAGGCGUNNNACTNNNTGAUCAAGUUGACCCUGGGUCUGAUC | 1515 | TGACAAGGCGTAGTCACGGUNNNACTNNNTGAUAAGCAUCAGCAUUUGACUUUACCUUAUC |
| 520 | TCTGTACGGTGACAAGGCGUNNNACTNNNTGAUGGAGGAAAAGAGGAUGCUGGAG | 1516 | TGACAAGGCGTAGTCACGGUNNNACTNNNTGAUGAAUCUCCAUUUUAGCACUUACCUGUGA |
| 521 | TCTGTACGGTGACAAGGCGUNNNACTNNNTGAUUGAACGUAAAAUGUGUCGCUCC | 1517 | TGACAAGGCGTAGTCACGGUNNNACTNNNTGAUAGAGUUUUUCCAAGAACCAAGUUCUUCC |
| 522 | TCTGTACGGTGACAAGGCGUNNNACTNNNTGAUCAUGUGCUGAAAAUCCGAAGUG | 1518 | TGACAAGGCGTAGTCACGGUNNNACTNNNTGAUAUCUUCCACCUUAAAUUCUGGUUCUGUA |
| 523 | TCTGTACGGTGACAAGGCGUNNNACTNNNTGAUCCUUAAUGCCUCAGAAACCACA | 1519 | TGACAAGGCGTAGTCACGGUNNNACTNNNTGAUCAUCAACUCAUGAAUUAGCUGGUUUCGA |
| 524 | TCTGTACGGTGACAAGGCGUNNNACTNNNTGAUACUUCUUGGCCAAGAGGAAGAC | 1520 | TGACAAGGCGTAGTCACGGUNNNACTNNNTGAUGAUCUUCAAUGGCUUUAGUCUGUUCCAA |
| 525 | TCTGTACGGTGACAAGGCGUNNNACTNNNTGAUAUUGGAGAUGGUUUCACAGCAC | 1521 | TGACAAGGCGTAGTCACGGUNNNACTNNNTGAUUGGAGAGAGAACAAAUAAAUGGUUACCUG |
| 526 | TCTGTACGGTGACAAGGCGUNNNACTNNNTGAUGGAAUCUCCCAGGCGGUAUUUG | 1522 | TGACAAGGCGTAGTCACGGUNNNACTNNNTGAUUAUUUUCAGCCUUCUACUAGUCGAAAGCG |
| 527 | TCTGTACGGTGACAAGGCGUNNNACTNNNTGAUCGCACUGCCCCAAGUUUUACUA | 1523 | TGACAAGGCGTAGTCACGGUNNNACTNNNTGAUAAAAUCCAAAUCAUAUACCAAAGCAUCCA |
| 528 | TCTGTACGGTGACAAGGCGUNNNACTNNNTGAUGAAGACGAAAACUCUGCGGAAG | 1524 | TGACAAGGCGTAGTCACGGUNNNACTNNNTGAUACUUUUAACACUUCACCUUUAACUGCUUC |
| 529 | TCTGTACGGTGACAAGGCGUNNNACTNNNTGAUUGAUCCUCUUCCCUCAGCUUCC | 1525 | TGACAAGGCGTAGTCACGGUNNNACTNNNTGAUCGUUGAUGAUUUCUAACCUUUUCUGGUUT |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 530 | TCTGTACGGTGACAAGGCGUNNNACTNNNTGAUGAGAUCACUGAUGACCUGCACT | 1526 | TGACAAGGCGTAGTCACGGUNNNACTNNNTGAUCUGGUUUCUGUAGAAUUCCAUGAGUAGUT |
| 531 | TCTGTACGGTGACAAGGCGUNNNACTNNNTGAUGCCUUCAAUGCACUGAUACACA | 1527 | TGACAAGGCGTAGTCACGGUNNNACTNNNTGAUGCUCUGGUAGAAUUGACAUAUCUCAACAC |
| 532 | TCTGTACGGTGACAAGGCGUNNNACTNNNTGAUUAUGUCAGCGUUUGGCUUAACA | 1528 | TGACAAGGCGTAGTCACGGUNNNACTNNNTGAUGGAGAUAUUUCACCUGACUUGAUUCAAGG |
| 533 | TCTGTACGGTGACAAGGCGUNNNACTNNNTGAUCCACCAUAUACAGGAGCUCAGA | 1529 | TGACAAGGCGTAGTCACGGUNNNACTNNNTGAUGUUUUUCUGGAUAAAAAGAGCCACUGUUC |
| 534 | TCTGTACGGTGACAAGGCGUNNNACTNNNTGAUUGUCUUUGGAACCACACCAGAA | 1530 | TGACAAGGCGTAGTCACGGUNNNACTNNNTGAUACAACCCACUGAGGUAUAUGUAUAGGUAUT |
| 535 | TCTGTACGGTGACAAGGCGUNNNACTNNNTGAUUUGAUAGCUGCACUGAGUGUCA | 1531 | TGACAAGGCGTAGTCACGGUNNNACTNNNTGAUAGAAAAUCAAAGCAUUCUUACCUUACUACA |
| 536 | TCTGTACGGTGACAAGGCGUNNNACTNNNTGAUGACCUGGAUCCACAGGAAAGAA | 1532 | TGACAAGGCGTAGTCACGGUNNNACTNNNTGAUUCCCAGAGAACAAAUUAAAAGAGUUAAGGA |
| 537 | TCTGTACGGTGACAAGGCGUNNNACTNNNTGAUGGACUUGCUUCUGCACUAGACA | 1533 | TGACAAGGCGTAGTCACGGUNNNACTNNNTGAUGCUUCUUUAAAUAGUUCAUGCUUUAUGGUT |
| 538 | TCTGTACGGTGACAAGGCGUNNNACTNNNTGAUGAUGACCUGGAAGAUGGAGUCT | 1534 | TGACAAGGCGTAGTCACGGUNNNACTNNNTGAUUCCGAAUAUAGAGAACCUCAAUCUCUUUGT |
| 539 | TCTGTACGGTGACAAGGCGUNNNACTNNNTGAUAGCUGGAAGAAGCUGAAAAAGC | 1535 | TGACAAGGCGTAGTCACGGUNNNACTNNNTGAUCAAUGCUUUUAAAUAUGUCAUUGUGGGCAT |
| 540 | TCTGTACGGTGACAAGGCGUNNNACTNNNTGAUAGAGAGAACGGUUGCAAAACUG | 1536 | TGACAAGGCGTAGTCACGGUNNNACTNNNTGAUGUACAACAGAUUAUCUCUGAAUUAGAGCGA |
| 541 | TCTGTACGGTGACAAGGCGUNNNACTNNNTGAUAGCUACAGUGAUGCCCACUACA | 1537 | TGACAAGGCGTAGTCACGGUNNNACTNNNTGAUUAGAUAAUGCUUAAUAUUCACUUCCCCGUG |
| 542 | TCTGTACGGTGACAAGGCGUNNNACTNNNTGAUCCUCAAACAGAACGGUCCAGUC | 1538 | TGACAAGGCGTAGTCACGGUNNNACTNNNTGAUUUUUUCCAGUUUAUUGUAUUUGCAUAGCACA |
| 543 | TCTGTACGGTGACAAGGCGUNNNACTNNNTGAUGCUCAGCUAGAAGAGAAGCAGC | 1539 | TGACAAGGCGTAGTCACGGUNNNACTNNNTGAUGAUCUACUGUUUUCCUUUACUUACUACACCT |
| 544 | TCTGTACGGTGACAAGGCGUNNNACTNNNTGAUGGGAGUGAUUUGCGCCAUCAUC | 1540 | TGACAAGGCGTAGTCACGGUNNNACTNNNTGAUAAAAUAUAGAACCUAAUGGAAGGAUUUGGUG |
| 545 | TCTGTACGGTGACAAGGCGUNNNACTNNNTGAUUCCCCCUGAUAGCAGAUUUGAT | 1541 | TGACAAGGCGTAGTCACGGUNNNACTNNNTGAUGGGUAUGGCAUAUAUCCAAGAGAAAAGAUUT |
| 546 | TCTGTACGGTGACAAGGCGUNNNACTNNNTGAUAUACCAGCUGAAGAGCGACAAG | 1542 | TGACAAGGCGTAGTCACGGUNNNACTNNNTGAUACCUUGCUAAGAGAUAUUCAUCUGUCUUUC |
| 547 | TCTGTACGGTGACAAGGCGUNNNACTNNNTGAUCAAACAUUCGUCUCGGAAACCC | 1543 | TGACAAGGCGTAGTCACGGUNNNACTNNNTGAUAUUCUGAUCUGGUUGAACUAUUACUUUCCA |
| 548 | TCTGTACGGTGACAAGGCGUNNNACTNNNTGAUUUUGGUGAUUUUGGCAUGAGCAG | 1544 | TGACAAGGCGTAGTCACGGUNNNACTNNNTGAUCCCUUCUUAAAUUGCUCCUGUAUCAUUGAUT |
| 549 | TCTGTACGGTGACAAGGCGUNNNACTNNNTGAUUCCGAGAUUGGAGCCUAACAGT | 1545 | TGACAAGGCGTAGTCACGGUNNNACTNNNTGAUAAAAGAAUAUGAAAAGAUGAUUUGAGAUGGUG |
| 550 | TCTGTACGGTGACAAGGCGUNNNACTNNNTGAUCAGCAAGAAUAUUCCCCUGGCA | 1546 | TGACAAGGCGTAGTCACGGUNNNACTNNNTGAUGGUUAGUAUGUUAUCAUUUGGGAAACCAAAUT |
| 551 | TCTGTACGGTGACAAGGCGUNNNACTNNNTGAUUCUCAUUUGCCUGGCAGAUCUC | 1547 | TGACAAGGCGTAGTCACGGUNNNACTNNNTGAUAAAAUCUGUUUUCCAAUAAAUUCUCAGAUCCA |
| 552 | TCTGTACGGTGACAAGGCGUNNNACTNNNTGAUGACAUCAGCAAAGACCUGGAGA | 1548 | TGACAAGGCGTAGTCACGGUNNNACTNNNTGAUCUAGAUAUGGUUAAGAAAACUGUUCCAAUACA |
| 553 | TCTGTACGGTGACAAGGCGUNNNACTNNNTGAUAGAACUUGCUGGUGAAAAUCGG | 1549 | TGACAAGGCGTAGTCACGGUNNNACTNNNTGAUAGAAUAGGAUAUUGUAUCAUACCAAUUUCUCG |
| 554 | TCTGTACGGTGACAAGGCGUNNNACTNNNTGAUUUCAUCCUGCACGAACAGAAAGA | 1550 | TGACAAGGCGTAGTCACGGUNNNACTNNNTGAUGAAUUAAACACACAUCACAUACAUACAAGUCA |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 555 | TCTGTACGGTGACAAGGCGUNNNACTNNNTGAUCCCAGGCACUUGAUGAUACUCAC | 1551 | TGACAAGGCGTAGTCACGGUNNNACTNNNTGAUUGUCUGUGUAAUCAAACAAGUUUAUAUUUCCC |
| 556 | TCTGTACGGTGACAAGGCGUNNNACTNNNTGAUGCCUCUCUCUCUUGUCACGUAGC | 1552 | TGACAAGGCGTAGTCACGGUNNNACTNNNTGAUUUCCCUUUUGUACUGAAUUUUAGAUUACUGAT |
| 557 | TCTGTACGGTGACAAGGCGUNNNACTNNNTGAUGGCCAUUUCUGUUUUCCUGUAGC | 1553 | TGACAAGGCGTAGTCACGGUNNNACTNNNTGAUCUGGAAGCUUUAACUUCUUUAUUAAGUUCUUC |
| 558 | TCTGTACGGTGACAAGGCGUNNNACTNNNTGAUCUUCGCCUGUCCUCAUGUAUUGG | 1554 | TGACAAGGCGTAGTCACGGUNNNACTNNNTGAUCUGUUCAAGAACUUCUGAAUUUAAAACAGUCT |
| 559 | TCTGTACGGTGACAAGGCGUNNNACTNNNTGAUAUCCGGGCUUUACGCAAAUAAGT | 1555 | TGACAAGGCGTAGTCACGGUNNNACTNNNTGAUUAGUAAGUAUGAAACUUGUUUCUGGUAUCCAA |
| 560 | TCTGTACGGTGACAAGGCGUNNNACTNNNTGAUUGGAUUUGACCCUCCAUGAUCAG | 1556 | TGACAAGGCGTAGTCACGGUNNNACTNNNTGAUUCUUUGGCACAAUAUUAACUAGUCUAUUGUAG |
| 561 | TCTGTACGGTGACAAGGCGUNNNACTNNNTGAUAUCUGUACAGCAUGAAGUGCAAG | 1557 | TGACAAGGCGTAGTCACGGUNNNACTNNNTGAUUGUCUGAUAUUCUUUCUCAUAUUUCUUCAGCT |
| 562 | TCTGTACGGTGACAAGGCGUNNNACTNNNTGAUAGUCGUCAGCCUGAACAUAACAT | 1558 | TGACAAGGCGTAGTCACGGUNNNACTNNNTGAUUUGCUCUUUUGAUUCUUUAAAUACAUCAAAGT |
| 563 | TCTGTACGGTGACAAGGCGUNNNACTNNNTGAUUGCUUCUCAGAUGAAACCACCAG | 1559 | TGACAAGGCGTAGTCACGGUNNNACTNNNTGAUGUUAUAUUGAAAAUGAUUAACAUGUAGAAGGGC |
| 564 | TCTGTACGGTGACAAGGCGUNNNACTNNNTGAUGCUGCACCUUGACUUUAAGUGAG | 1560 | TGACAAGGCGTAGTCACGGUNNNACTNNNTGAUUUAAGUGACAUACCAAUUUGUACAACAGUUAUC |
| 565 | TCTGTACGGTGACAAGGCGUNNNACTNNNTGAUCCGAGAAUGGUCAUAAAUGUGCA | 1561 | TGACAAGGCGTAGTCACGGUNNNACTNNNTGAUCAACAUGCUGAUUCUUUCAACGUUUUAUUUUC |
| 566 | TCTGTACGGTGACAAGGCGUNNNACTNNNTGAUCACUAUGGAGCUCUCACAUGUGG | 1562 | TGACAAGGCGTAGTCACGGUNNNACTNNNTGAUGUGGUAUUCUGUCUUUAAUUGUAAGAUAUGCAA |
| 567 | TCTGTACGGTGACAAGGCGUNNNACTNNNTGAUACCCGAAGAAAGAGACUCUGGAA | 1563 | TGACAAGGCGTAGTCACGGUNNNACTNNNTGAUUGUUCCUGUGUCAACUUAAUCAUUUGUUUGAUA |
| 568 | TCTGTACGGTGACAAGGCGUNNNACTNNNTGAUCUCACAUUGCCCCUGACAACAUA | | |
| 569 | TCTGTACGGTGACAAGGCGUNNNACTNNNTGAUUAAGGGACCAGGGUCUAUGAAGC | | |
| 570 | TCTGTACGGTGACAAGGCGUNNNACTNNNTGAUGUGUCCUUUCAGGAUGGUGGAUG | | |
| 571 | TCTGTACGGTGACAAGGCGUNNNACTNNNTGAUACAGGAAGAGCACAGUCACUUUG | | |
| 572 | TCTGTACGGTGACAAGGCGUNNNACTNNNTGAUGAUGCCCCAAGAAUCCUAGUAG | | |
| 573 | TCTGTACGGTGACAAGGCGUNNNACTNNNTGAUUCCUCAACCCUCUUCUCAUCAGG | | |
| 574 | TCTGTACGGTGACAAGGCGUNNNACTNNNTGAUUUCUUUGAGGUGAAGCCAAACCT | | |
| 575 | TCTGTACGGTGACAAGGCGUNNNACTNNNTGAUUCCCCUACCUAGACCCUCCUAAC | | |
| 576 | TCTGTACGGTGACAAGGCGUNNNACTNNNTGAUGCUCCAGAAGCCCUGUUUGAUAG | | |
| 577 | TCTGTACGGTGACAAGGCGUNNNACTNNNTGAUUCAUUCCUGUGUCGUCUAGCCUT | | |
| 578 | TCTGTACGGTGACAAGGCGUNNNACTNNNTGAUGGUUAUUAUGAGGAAGCUGUGCC | | |
| 579 | TCTGTACGGTGACAAGGCGUNNNACTNNNTGAUCUUUGAACUCCAAGCUGCUCAAG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 580 | TCTGTACGGTGACAAGGCGUNNNACTNN NTGAUACGUCAUGGAGUAUAUGUGUGGG | | |
| 581 | TCTGTACGGTGACAAGGCGUNNNACTNN NTGAUAACUACCACCUGUCCUACACCUG | | |
| 582 | TCTGTACGGTGACAAGGCGUNNNACTNN NTGAUGUUGGUAUCCCUUCAGGACUAGG | | |
| 583 | TCTGTACGGTGACAAGGCGUNNNACTNN NTGAUCUCAGCAGACAAUAUCGGAUCGA | | |
| 584 | TCTGTACGGTGACAAGGCGUNNNACTNN NTGAUACUUGGAGAAGCUGAGAGAAAAC | | |
| 585 | TCTGTACGGTGACAAGGCGUNNNACTNN NTGAUUCCAGGUCAUGAAGGAGUACUUG | | |
| 586 | TCTGTACGGTGACAAGGCGUNNNACTNN NTGAUGACCUUCAUGAGCUGCAAUCUCA | | |
| 587 | TCTGTACGGTGACAAGGCGUNNNACTNN NTGAUUGUUUCAGUAUCCCUGCUCCAAA | | |
| 588 | TCTGTACGGTGACAAGGCGUNNNACTNN NTGAUAAGAUGUCAUCAUCAACCAAGCA | | |
| 589 | TCTGTACGGTGACAAGGCGUNNNACTNN NTGAUACUCCAUGUUCUUGGCCAUGCUA | | |
| 590 | TCTGTACGGTGACAAGGCGUNNNACTNN NTGAUGGAGCUGGUUCACAUGAUCAACT | | |
| 591 | TCTGTACGGTGACAAGGCGUNNNACTNN NTGAUAUAUUUCUUCCGCAAGUGUGUCC | | |
| 592 | TCTGTACGGTGACAAGGCGUNNNACTNN NTGAUAAACUCGAACUGAUUUCUCCUGG | | |
| 593 | TCTGTACGGTGACAAGGCGUNNNACTNN NTGAUGGCGCUGUCAACAGAAAGAAAAA | | |
| 594 | TCTGTACGGTGACAAGGCGUNNNACTNN NTGAUCCAACGUUCAAGCAGUUGGUAGA | | |
| 595 | TCTGTACGGTGACAAGGCGUNNNACTNN NTGAUUAACCAAGAGGAAGUUGGAGGUG | | |
| 596 | TCTGTACGGTGACAAGGCGUNNNACTNN NTGAUGGUAGAGGAGGUGUUUGAUGUUC | | |
| 597 | TCTGTACGGTGACAAGGCGUNNNACTNN NTGAUGAUCCUCCUUGCUUACCACACAC | | |
| 598 | TCTGTACGGTGACAAGGCGUNNNACTNN NTGAUGCCCUUCGAGAGCAAGUUUAAGA | | |
| 599 | TCTGTACGGTGACAAGGCGUNNNACTNN NTGAUCAAGUGACUCUUCAGAUCCCUGC | | |
| 600 | TCTGTACGGTGACAAGGCGUNNNACTNN NTGAUACAUGAAAGGGAGUUUGGUUCUG | | |
| 601 | TCTGTACGGTGACAAGGCGUNNNACTNN NTGAUUGCUAAAAGAGAGGGAGAGUGAT | | |
| 602 | TCTGTACGGTGACAAGGCGUNNNACTNN NTGAUGGAGGAACUGGACUUCCAGAAGA | | |
| 603 | TCTGTACGGTGACAAGGCGUNNNACTNN NTGAUUGGGAUCUUCGUAGCAUCAGUUG | | |
| 604 | TCTGTACGGTGACAAGGCGUNNNACTNN NTGAUGCAGAACCAUCCACCAACAUAAG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 605 | TCTGTACGGTGACAAGGCGUNNNACTNN NTGAUAGAGUUAAAUGCCCUCAAGUCGA | | |
| 606 | TCTGTACGGTGACAAGGCGUNNNACTNN NTGAUUGGGUUUUUCCUGUGGCUGAAAA | | |
| 607 | TCTGTACGGTGACAAGGCGUNNNACTNN NTGAUAGGACUGGGUGAAUGCUAUUGAG | | |
| 608 | TCTGTACGGTGACAAGGCGUNNNACTNN NTGAUACCAGGGAUGAGCAGAAUGAAGA | | |
| 609 | TCTGTACGGTGACAAGGCGUNNNACTNN NTGAUAAGACGGUCCGUAAACUGAAAAA | | |
| 610 | TCTGTACGGTGACAAGGCGUNNNACTNN NTGAUCAGGGAUAUAUCCCCCAAAGGAT | | |
| 611 | TCTGTACGGTGACAAGGCGUNNNACTNN NTGAUGGUUAUUAAGGAGCUUCGCAAGG | | |
| 612 | TCTGTACGGTGACAAGGCGUNNNACTNN NTGAUGCAUGUCCAGAGAUGUCUACAGC | | |
| 613 | TCTGTACGGTGACAAGGCGUNNNACTNN NTGAUGCCGUAUUUGAAGCCUCAGGAAC | | |
| 614 | TCTGTACGGTGACAAGGCGUNNNACTNN NTGAUUCCAGAAGUCCAGAGCUGAGAAG | | |
| 615 | TCTGTACGGTGACAAGGCGUNNNACTNN NTGAUCUAGACAUCUUCUCCCUCCCUUG | | |
| 616 | TCTGTACGGTGACAAGGCGUNNNACTNN NTGAUUAUCGCAGGAGAGACUGUGAUUC | | |
| 617 | TCTGTACGGTGACAAGGCGUNNNACTNN NTGAUCAGCAGAUGAAUCACCUUUCGUT | | |
| 618 | TCTGTACGGTGACAAGGCGUNNNACTNN NTGAUCUGAGGAUGCUCAAAGGGUUUUT | | |
| 619 | TCTGTACGGTGACAAGGCGUNNNACTNN NTGAUAGGCUCCUGAGACCUUUGAUAAC | | |
| 620 | TCTGTACGGTGACAAGGCGUNNNACTNN NTGAUGGAUGAGCAAGACCUAAAUGAGC | | |
| 621 | TCTGTACGGTGACAAGGCGUNNNACTNN NTGAUCUAUUGUAAGCAGGCGAUGUUGT | | |
| 622 | TCTGTACGGTGACAAGGCGUNNNACTNN NTGAUCCUUAGCUGUUGAAGGAAAACGA | | |
| 623 | TCTGTACGGTGACAAGGCGUNNNACTNN NTGAUUGAAUUCCUGAAGAACGUUGGG | | |
| 624 | TCTGTACGGTGACAAGGCGUNNNACTNN NTGAUUACGUGAAGGAUGACAUCUUCCG | | |
| 625 | TCTGTACGGTGACAAGGCGUNNNACTNN NTGAUGUGCCUUUGAAAAUCAACGACAA | | |
| 626 | TCTGTACGGTGACAAGGCGUNNNACTNN NTGAUGACCUAAAGACCAUUGCACUUCG | | |
| 627 | TCTGTACGGTGACAAGGCGUNNNACTNN NTGAUCUUGUCAGGGAACAGGAAGAAUT | | |
| 628 | TCTGTACGGTGACAAGGCGUNNNACTNN NTGAUAAUAAAACUUUGCUGCCACCUGT | | |
| 629 | TCTGTACGGTGACAAGGCGUNNNACTNN NTGAUAACAACAGGAGUUGCCAUUCCAT | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 630 | TCTGTACGGTGACAAGGCGUNNNACTNNNTGAUGUGAUCCUAGUUUCUGGGCUCAA | | |
| 631 | TCTGTACGGTGACAAGGCGUNNNACTNNNTGAUAUCAGGAAGAGGAAGAGUCCACA | | |
| 632 | TCTGTACGGTGACAAGGCGUNNNACTNNNTGAUAAAGAGGGACUGCCAUAACAUUC | | |
| 633 | TCTGTACGGTGACAAGGCGUNNNACTNNNTGAUACUGCCUUCUGAAAGGUGGAAUC | | |
| 634 | TCTGTACGGTGACAAGGCGUNNNACTNNNTGAUGUGGGAAUUGACAAAGACAAGCC | | |
| 635 | TCTGTACGGTGACAAGGCGUNNNACTNNNTGAUACAGCCCAAAGAUGAGAGUGAUT | | |
| 636 | TCTGTACGGTGACAAGGCGUNNNACTNNNTGAUGGUUUCAGACGCUGAAGGAUUUT | | |
| 637 | TCTGTACGGTGACAAGGCGUNNNACTNNNTGAUUGAUGUGGACUGGAUAGUCACUG | | |
| 638 | TCTGTACGGTGACAAGGCGUNNNACTNNNTGAUCUAUUAACUCCGAGCACUUAGCGA | | |
| 639 | TCTGTACGGTGACAAGGCGUNNNACTNNNTGAUGUAUCUUCUAGCUCUCUGCCUACC | | |
| 640 | TCTGTACGGTGACAAGGCGUNNNACTNNNTGAUUGACAGCCAUCAUCAAAGAGAUCG | | |
| 641 | TCTGTACGGTGACAAGGCGUNNNACTNNNTGAUAUUGUGAAGAUCUGUGACUUUGGC | | |
| 642 | TCTGTACGGTGACAAGGCGUNNNACTNNNTGAUGAGCGAAUUCCUUUGGAAAACCUG | | |
| 643 | TCTGTACGGTGACAAGGCGUNNNACTNNNTGAUUAUCCAGUGUGCCCACUACAUUGA | | |
| 644 | TCTGTACGGTGACAAGGCGUNNNACTNNNTGAUUUCUUUUUCAGAGUGCAACCAGCA | | |
| 645 | TCTGTACGGTGACAAGGCGUNNNACTNNNTGAUCUUGCAAGCAAAAAGUUUGUCCAC | | |
| 646 | TCTGTACGGTGACAAGGCGUNNNACTNNNTGAUCCUUGGUGUAGCACUGACAUUCAT | | |
| 647 | TCTGTACGGTGACAAGGCGUNNNACTNNNTGAUCUUGGGUCACUGUAUGGGAUGUAG | | |
| 648 | TCTGTACGGTGACAAGGCGUNNNACTNNNTGAUUCUGAUUUGCCAAGUUGCUCUCUT | | |
| 649 | TCTGTACGGTGACAAGGCGUNNNACTNNNTGAUUUUUUCUGUCCACCAGGGAGUAAC | | |
| 650 | TCTGTACGGTGACAAGGCGUNNNACTNNNTGAUGUUACUGCCAUCGACUUACAUUGG | | |
| 651 | TCTGTACGGTGACAAGGCGUNNNACTNNNTGAUGAGAUAGUGGUGAAGGACAAUGGC | | |
| 652 | TCTGTACGGTGACAAGGCGUNNNACTNNNTGAUGUCCUCAUGUACUGGUCCCUCAUT | | |
| 653 | TCTGTACGGTGACAAGGCGUNNNACTNNNTGAUCUGAAUUAGCUGUAUCGUCAAGGC | | |
| 654 | TCTGTACGGTGACAAGGCGUNNNACTNNNTGAUCGAUGCUGAGAACCAAUACCAGAC | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 655 | TCTGTACGGTGACAAGGCGUNNNACTNNNTGAUCU CUGCUGGAUCAUGUGAGACAAC | | |
| 656 | TCTGTACGGTGACAAGGCGUNNNACTNNNTGAUCA UCUGGAUACAUGCCCAUGAACC | | |
| 657 | TCTGTACGGTGACAAGGCGUNNNACTNNNTGAUUU CAGAAUCUUGUUGGCUGCAUUG | | |
| 658 | TCTGTACGGTGACAAGGCGUNNNACTNNNTGAUGG AGAAUGUGAAAAUUCCAGUGGC | | |
| 659 | TCTGTACGGTGACAAGGCGUNNNACTNNNTGAUCU GAGUGUAUCCUGGAGGUUGUUG | | |
| 660 | TCTGTACGGTGACAAGGCGUNNNACTNNNTGAUCU GACCAUGUGGACAUUAGGUGUG | | |
| 661 | TCTGTACGGTGACAAGGCGUNNNACTNNNTGAUCC UGAAGAAGACCUUUGACUCUGT | | |
| 662 | TCTGTACGGTGACAAGGCGUNNNACTNNNTGAUGA GGAGGAGGAUGAGAUUCUUCCA | | |
| 663 | TCTGTACGGTGACAAGGCGUNNNACTNNNTGAUCU cCUAGAAGACUCCAAGGGAGUA | | |
| 664 | TCTGTACGGTGACAAGGCGUNNNACTNNNTGAUUG GACGACAUAUACCUGUGUGCUA | | |
| 665 | TCTGTACGGTGACAAGGCGUNNNACTNNNTGAUAA UGCUACGAAGUGGGAAUGAUGA | | |
| 666 | TCTGTACGGTGACAAGGCGUNNNACTNNNTGAUUC AGGCUACCAUUAUGGAGUCUGG | | |
| 667 | TCTGTACGGTGACAAGGCGUNNNACTNNNTGAUUC UUACAAUGGCAGGACCAUUCUG | | |
| 668 | TCTGTACGGTGACAAGGCGUNNNACTNNNTGAUUU GGAAGUGGUCAUUUCAGAUGUG | | |
| 669 | TCTGTACGGTGACAAGGCGUNNNACTNNNTGAUAA GAGAUGCGCCAAUUGUAAACAA | | |
| 670 | TCTGTACGGTGACAAGGCGUNNNACTNNNTGAUAA UUUCUCCUUCAGACAAUGCAGT | | |
| 671 | TCTGTACGGTGACAAGGCGUNNNACTNNNTGAUGC UCUUCCAGCUUAAGAAUGAACC | | |
| 672 | TCTGTACGGTGACAAGGCGUNNNACTNNNTGAUAU ACAGAAGCUGAUGGGCCAGAUA | | |
| 673 | TCTGTACGGTGACAAGGCGUNNNACTNNNTGAUUC AGAAUUACCAAGCUACGGAAGC | | |
| 674 | TCTGTACGGTGACAAGGCGUNNNACTNNNTGAUUC GUUAAAGUCUCUCUUCACCCUG | | |
| 675 | TCTGTACGGTGACAAGGCGUNNNACTNNNTGAUGC cCCAUCUAUGAGUUCAAGAUCA | | |
| 676 | TCTGTACGGTGACAAGGCGUNNNACTNNNTGAUCC GAGUGGCGGAAAGCAAUAAAAT | | |
| 677 | TCTGTACGGTGACAAGGCGUNNNACTNNNTGAUGG ACAAAGGGUGGAUGAAAUUGAT | | |
| 678 | TCTGTACGGTGACAAGGCGUNNNACTNNNTGAUCC AGUGAUGAUCUCAAUGGGCAAT | | |
| 679 | TCTGTACGGTGACAAGGCGUNNNACTNNNTGAUCG AGGUGUUUUUACCACCAAGACT | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 680 | TCTGTACGGTGACAAGGCGUNNNACTNNNTGAUGUAAAUGACUGUGUCCAGCAAGUT | | |
| 681 | TCTGTACGGTGACAAGGCGUNNNACTNNNTGAUACAGCUGCCUACAUAAAGGAAUGG | | |
| 682 | TCTGTACGGTGACAAGGCGUNNNACTNNNTGAUGUUUGCAAGAUGAAAGGAGAAGGG | | |
| 683 | TCTGTACGGTGACAAGGCGUNNNACTNNNTGAUACACUGGAAAGGAAGAGAUUCAUG | | |
| 684 | TCTGTACGGTGACAAGGCGUNNNACTNNNTGAUUACUGGAGGAGAUGGUCAAGAAUC | | |
| 685 | TCTGTACGGTGACAAGGCGUNNNACTNNNTGAUUUGUACACAUGUACAAUGCCCAAT | | |
| 686 | TCTGTACGGTGACAAGGCGUNNNACTNNNTGAUGCACUUUUUGGAUACUUUGUGCCT | | |
| 687 | TCTGTACGGTGACAAGGCGUNNNACTNNNTGAUCGCAAUUUAUGUUUUCCAAGCCAC | | |
| 688 | TCTGTACGGTGACAAGGCGUNNNACTNNNTGAUGCUCCCUGGAUAUUCUUAGUAGCG | | |
| 689 | TCTGTACGGTGACAAGGCGUNNNACTNNNTGAUAGAGCUCGAAUUCCAGAAUGAUGA | | |
| 690 | TCTGTACGGTGACAAGGCGUNNNACTNNNTGAUCUUCAGCGAGGAAGCUACACUUUT | | |
| 691 | TCTGTACGGTGACAAGGCGUNNNACTNNNTGAUUCAUCAAGUCCUUUGACAGUGCAT | | |
| 692 | TCTGTACGGTGACAAGGCGUNNNACTNNNTGAUUCAGAAGUGGUUUCCUUUCUCACC | | |
| 693 | TCTGTACGGTGACAAGGCGUNNNACTNNNTGAUAAGUUUCGGACAGUACAAAGAACG | | |
| 694 | TCTGTACGGTGACAAGGCGUNNNACTNNNTGAUGAAGUCCAAGUUGCUUCUCAGUCT | | |
| 695 | TCTGTACGGTGACAAGGCGUNNNACTNNNTGAUGCUUGGAGCAAGAAAAGGAAUUGC | | |
| 696 | TCTGTACGGTGACAAGGCGUNNNACTNNNTGAUACCAAUCCAGAAAACCUUCCAUCG | | |
| 697 | TCTGTACGGTGACAAGGCGUNNNACTNNNTGAUCAGUGUGCCAGAUACCAUUGAUGA | | |
| 698 | TCTGTACGGTGACAAGGCGUNNNACTNNNTGAUUCAUCAUUAUUCUGGCUGGAGCAA | | |
| 699 | TCTGTACGGTGACAAGGCGUNNNACTNNNTGAUAUGUAGGCUUUUGUUUCGUUUGUG | | |
| 700 | TCTGTACGGTGACAAGGCGUNNNACTNNNTGAUCUGGCAACAAACAAGAUACUGGUG | | |
| 701 | TCTGTACGGTGACAAGGCGUNNNACTNNNTGAUUCGUGGCUUUUGACAAUAUCUCCA | | |
| 702 | TCTGTACGGTGACAAGGCGUNNNACTNNNTGAUAGAAUAACUCCUCGGUUCUAGGGC | | |
| 703 | TCTGTACGGTGACAAGGCGUNNNACTNNNTGAUUCUCUGAGUAUGAGCUUCCCGAAG | | |
| 704 | TCTGTACGGTGACAAGGCGUNNNACTNNNTGAUACGUCCAUCUUUUUAAGGGAUUGC | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 705 | TCTGTACGGTGACAAGGCGUNNNACTNNNTGAUGUCAUUACGUCAACGCAACGUCUA | | |
| 706 | TCTGTACGGTGACAAGGCGUNNNACTNNNTGAUUCCACACAUAAACGGCAGUGUUAA | | |
| 707 | TCTGTACGGTGACAAGGCGUNNNACTNNNTGAUGAGAAAAGCCUGUUUACCAAGGAG | | |
| 708 | TCTGTACGGTGACAAGGCGUNNNACTNNNTGAUGGAGAUCUUCACCUAUGGAAAGCA | | |
| 709 | TCTGTACGGTGACAAGGCGUNNNACTNNNTGAUCGUGUUGUGGGAGALRMUCACCUA | | |
| 710 | TCTGTACGGTGACAAGGCGUNNNACTNNNTGAUACUGACUUUUACUCCAGGCUAACUT | | |
| 711 | TCTGTACGGTGACAAGGCGUNNNACTNNNTGAUUGUCCUGGUCAUUUAUAGAAACCGA | | |
| 712 | TCTGTACGGTGACAAGGCGUNNNACTNNNTGAUAGUUCGUGGGCUUGUUUUGUAUCAA | | |
| 713 | TCTGTACGGTGACAAGGCGUNNNACTNNNTGAUGGUUGAAUGUAAGGCUUACAACGAT | | |
| 714 | TCTGTACGGTGACAAGGCGUNNNACTNNNTGAUGUGGUUCUGGAUUAGCUGGAUUGUC | | |
| 715 | TCTGTACGGTGACAAGGCGUNNNACTNNNTGAUAUGUGCCUCCUUCAGGAAUUCAAUC | | |
| 716 | TCTGTACGGTGACAAGGCGUNNNACTNNNTGAUAACCAAGUUCUUUCUUUUGCACAGG | | |
| 717 | TCTGTACGGTGACAAGGCGUNNNACTNNNTGAUUUGUGGGCUACAAGAACUACCGAUA | | |
| 718 | TCTGTACGGTGACAAGGCGUNNNACTNNNTGAUGACCUCACCAUAGCUAAUCUUGGGA | | |
| 719 | TCTGTACGGTGACAAGGCGUNNNACTNNNTGAUCCAGCACUUCUGCAUUGGAACUAUT | | |
| 720 | TCTGTACGGTGACAAGGCGUNNNACTNNNTGAUUUGCAUUGUGUGUUUUUGACCACUG | | |
| 721 | TCTGTACGGTGACAAGGCGUNNNACTNNNTGAUCCCUCAUUCCUUUUUCCUCUGUGUA | | |
| 722 | TCTGTACGGTGACAAGGCGUNNNACTNNNTGAUCCCAGCCAAGUAGAAUGUGAAAGAC | | |
| 723 | TCTGTACGGTGACAAGGCGUNNNACTNNNTGAUGUUUUUCCUCCUACUCACCAUCCUG | | |
| 724 | TCTGTACGGTGACAAGGCGUNNNACTNNNTGAUUCUCAAAUUGUUGCCAUUUCAGGGT | | |
| 725 | TCTGTACGGTGACAAGGCGUNNNACTNNNTGAUGAGCCUGUUUUGUGUCUACUGUUCT | | |
| 726 | TCTGTACGGTGACAAGGCGUNNNACTNNNTGAUGGACCAGAGCUUCAAGACUGUUUAG | | |
| 727 | TCTGTACGGTGACAAGGCGUNNNACTNNNTGAUUCCUCCUCCUCUUCCCUAGAUAACT | | |
| 728 | TCTGTACGGTGACAAGGCGUNNNACTNNNTGAUCAUCAUUCUUGAGGAGGAAGUAGCG | | |
| 729 | TCTGTACGGTGACAAGGCGUNNNACTNNNTGAUCACUCUACCUCCAGCACAGAAUUUG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 730 | TCTGTACGGTGACAAGGCGUNNNACTNNNTGAUCC UUAGACAACUACCUUUCUACGGA | | |
| 731 | TCTGTACGGTGACAAGGCGUNNNACTNNNTGAUUC CUUGUUGGUGUCCAUUUUCUUGT | | |
| 732 | TCTGTACGGTGACAAGGCGUNNNACTNNNTGAUAC UCCUCUUCAGAGGAGAAAGAAAC | | |
| 733 | TCTGTACGGTGACAAGGCGUNNNACTNNNTGAUUG ACUAAGAAUGGGAAGGAGUCACC | | |
| 734 | TCTGTACGGTGACAAGGCGUNNNACTNNNTGAUUC CUGUUCCUCCCAGUUUAAGAUUT | | |
| 735 | TCTGTACGGTGACAAGGCGUNNNACTNNNTGAUGC CAACACAAGAGAAAAUAUUUGCT | | |
| 736 | TCTGTACGGTGACAAGGCGUNNNACTNNNTGAUCC AUCUCAUUAAUGACAAUCAGCCA | | |
| 737 | TCTGTACGGTGACAAGGCGUNNNACTNNNTGAUAA GCAGAGGCAUCUGUAAAGUCAUG | | |
| 738 | TCTGTACGGTGACAAGGCGUNNNACTNNNTGAUAG CAGUUGAAAACUCCUAGAAGCC | | |
| 739 | TCTGTACGGTGACAAGGCGUNNNACTNNNTGAUCA GCAGUACACUACCAACAGAUCAA | | |
| 740 | TCTGTACGGTGACAAGGCGUNNNACTNNNTGAUCC UUACCAGCUUUGACAAUACAGGA | | |
| 741 | TCTGTACGGTGACAAGGCGUNNNACTNNNTGAUGC CUCUGAGAAGUAUGUCUGAUCCA | | |
| 742 | TCTGTACGGTGACAAGGCGUNNNACTNNNTGAUAG AAAGUACCAAUCAGAAGGACGUG | | |
| 743 | TCTGTACGGTGACAAGGCGUNNNACTNNNTGAUAU CAGAGCCAGAAUUUUGCAGAAGA | | |
| 744 | TCTGTACGGTGACAAGGCGUNNNACTNNNTGAUUC AACCAGAUGCAGUAUGAGUACAC | | |
| 745 | TCTGTACGGTGACAAGGCGUNNNACTNNNTGAUUC CAAGUCUUAUGGUUCUGGAUCAA | | |
| 746 | TCTGTACGGTGACAAGGCGUNNNACTNNNTGAUGA AGUGAAACUGUGUGAGAAGAUGG | | |
| 747 | TCTGTACGGTGACAAGGCGUNNNACTNNNTGAUAU GUCUAACUCGGGAGACUAUGAAA | | |
| 748 | TCTGTACGGTGACAAGGCGUNNNACTNNNTGAUGA AAAGAAACUCUUUCAUCUGCUGC | | |
| 749 | TCTGTACGGTGACAAGGCGUNNNACTNNNTGAUCU CUGGCGUUGGUGUUUUCAAAAUA | | |
| 750 | TCTGTACGGTGACAAGGCGUNNNACTNNNTGAUGG UGAAUAACAACUUGAGUGACGAG | | |
| 751 | TCTGTACGGTGACAAGGCGUNNNACTNNNTGAUAA AGAUGCUGAAAUCCAGAAGCUGA | | |
| 752 | TCTGTACGGTGACAAGGCGUNNNACTNNNTGAUGA CUAGCUGCCAAGUACUUGGAUAA | | |
| 753 | TCTGTACGGTGACAAGGCGUNNNACTNNNTGAUAU AAUGCUGUUUCCUUUACCUGGGA | | |
| 754 | TCTGTACGGTGACAAGGCGUNNNACTNNNTGAUAG GUCAAAGAAUAUGGCCAGAAGAG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 755 | TCTGTACGGTGACAAGGCGUNNNACTNNNTGAUGU AAACCAACAGCUCACAAAGGAGA | | |
| 756 | TCTGTACGGTGACAAGGCGUNNNACTNNNTGAUUU GAAGAGCAUCAACAAGAAGACCA | | |
| 757 | TCTGTACGGTGACAAGGCGUNNNACTNNNTGAUCU UGAAAUCCGCCUGAAUGAACAAG | | |
| 758 | TCTGTACGGTGACAAGGCGUNNNACTNNNTGAUUC UUAAGGUUGAAGUGUGGUUCAGG | | |
| 759 | TCTGTACGGTGACAAGGCGUNNNACTNNNTGAUUU UUCUUUCUCAGAAAGCAGAGGCT | | |
| 760 | TCTGTACGGTGACAAGGCGUNNNACTNNNTGAUAG UAUCAACAUCACGGACAUCUCAA | | |
| 761 | TCTGTACGGTGACAAGGCGUNNNACTNNNTGAUCC UCUAAAGAUCAAAACACCCCUGT | | |
| 762 | TCTGTACGGTGACAAGGCGUNNNACTNNNTGAUUA GAACGAGUAAAUCUGUCUGCAGC | | |
| 763 | TCTGTACGGTGACAAGGCGUNNNACTNNNTGAUUC AUCGUGAUUCAGGAGACAAUUCT | | |
| 764 | TCTGTACGGTGACAAGGCGUNNNACTNNNTGAUAG CUGUUUCUGGUGUUAUCAGUGAC | | |
| 765 | TCTGTACGGTGACAAGGCGUNNNACTNNNTGAUUA CAUGGCACUAGAAGAACGCUUAG | | |
| 766 | TCTGTACGGTGACAAGGCGUNNNACTNNNTGAUGC AAAGACAAAUGUGAAAUUGUGGG | | |
| 767 | TCTGTACGGTGACAAGGCGUNNNACTNNNTGAUAA CACAUUCAUUCAUAACACUGGGA | | |
| 768 | TCTGTACGGTGACAAGGCGUNNNACTNNNTGAUCU UAAUCAGCAAGCUUUCUCUGCUG | | |
| 769 | TCTGTACGGTGACAAGGCGUNNNACTNNNTGAUGA GAUGCAAGCAGUUAUUGAUGCAA | | |
| 770 | TCTGTACGGTGACAAGGCGUNNNACTNNNTGAUAU AGCAAGAAGGAAGUGCCUAUCCA | | |
| 771 | TCTGTACGGTGACAAGGCGUNNNACTNNNTGAUUC CCACAGCUAAUUUGGACCAAAAG | | |
| 772 | TCTGTACGGTGACAAGGCGUNNNACTNNNTGAUGU UUCUUCGUCUUAUCUUUGGGACC | | |
| 773 | TCTGTACGGTGACAAGGCGUNNNACTNNNTGAUCA GGAAGCCAGAGUUUAUUAACUGC | | |
| 774 | TCTGTACGGTGACAAGGCGUNNNACTNNNTGAUAG AUGAGAAGAAGCACCAUGACAAT | | |
| 775 | TCTGTACGGTGACAAGGCGUNNNACTNNNTGAUAG AGGGUAAAGUUCACAAAAGACCA | | |
| 776 | TCTGTACGGTGACAAGGCGUNNNACTNNNTGAUGC CAAAAAUGUGCAUACUCACAGAG | | |
| 777 | TCTGTACGGTGACAAGGCGUNNNACTNNNTGAUUG UAUCAUCUCCUGAAGCAACAUCT | | |
| 778 | TCTGTACGGTGACAAGGCGUNNNACTNNNTGAUCC UGGAUAAUGAAAGACUCCUUCCC | | |
| 779 | TCTGTACGGTGACAAGGCGUNNNACTNNNTGAUUC AGAUAGCAUACAAGAGACCAUGC | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 780 | TCTGTACGGTGACAAGGCGUNNNACTNNNTGAUGAAAGACCAAGAAGAACUUACUCCCT | | |
| 781 | TCTGTACGGTGACAAGGCGUNNNACTNNNTGAUGUGAUCUAUUUUCCCUUUCUCCCCA | | |
| 782 | TCTGTACGGTGACAAGGCGUNNNACTNNNTGAUAGCAAGAGGCUUUGGAGUAUUUCAUG | | |
| 783 | TCTGTACGGTGACAAGGCGUNNNACTNNNTGAUACAAAUGCUGAAAGCUGUACCAUACC | | |
| 784 | TCTGTACGGTGACAAGGCGUNNNACTNNNTGAUACUAGGUGAAUACUGUUCGAGAGGUT | | |
| 785 | TCTGTACGGTGACAAGGCGUNNNACTNNNTGAUCUCCAUGCCUUUGAGAACCUAGAAAT | | |
| 786 | TCTGTACGGTGACAAGGCGUNNNACTNNNTGAUUUCAAAAGGAAGUAUCUUGGCCUCCA | | |
| 787 | TCTGTACGGTGACAAGGCGUNNNACTNNNTGAUAAACGCUGUGCCAAUUUUGUAAAUGT | | |
| 788 | TCTGTACGGTGACAAGGCGUNNNACTNNNTGAUCAAUCAUGUUGCAGCAAUUCACUGUA | | |
| 789 | TCTGTACGGTGACAAGGCGUNNNACTNNNTGAUCACUUUACCCUGUAAUAAUCCGUGCT | | |
| 790 | TCTGTACGGTGACAAGGCGUNNNACTNNNTGAUCAGUGAUGAGAGUGACAUGUACUGUT | | |
| 791 | TCTGTACGGTGACAAGGCGUNNNACTNNNTGAUGAGUCCCAACCAUGUCAAAAUUACAG | | |
| 792 | TCTGTACGGTGACAAGGCGUNNNACTNNNTGAUAUUGCCAACAUGACUUACUUGAUCCC | | |
| 793 | TCTGTACGGTGACAAGGCGUNNNACTNNNTGAUUUACCCUCUUCAGCUCAGUUUCUUUC | | |
| 794 | TCTGTACGGTGACAAGGCGUNNNACTNNNTGAUGGUGAGAUCCAUUGACCUCAAUUUUG | | |
| 795 | TCTGTACGGTGACAAGGCGUNNNACTNNNTGAUGGUGGACCCCAAGCUUUAGUAAAUAT | | |
| 796 | TCTGTACGGTGACAAGGCGUNNNACTNNNTGAUAAAUACCCCUCCAUCAACUUCUUCA | | |
| 797 | TCTGTACGGTGACAAGGCGUNNNACTNNNTGAUAUCCAAAGAUCAAAGAGACGAAGUCT | | |
| 798 | TCTGTACGGTGACAAGGCGUNNNACTNNNTGAUAUUAGAGAACUACCCUGGAAUGACCC | | |
| 799 | TCTGTACGGTGACAAGGCGUNNNACTNNNTGAUCCUUGCUUACCUGAGGAACUUAUUCA | | |
| 800 | TCTGTACGGTGACAAGGCGUNNNACTNNNTGAUCCACAUUACAUACUUACCAUGCCACT | | |
| 801 | TCTGTACGGTGACAAGGCGUNNNACTNNNTGAUGGGAAGCUGUCCAUCAGUAUACAUUC | | |
| 802 | TCTGTACGGTGACAAGGCGUNNNACTNNNTGAUUGUCUAUAUCCAUCUCCAUGUCCUCT | | |
| 803 | TCTGTACGGTGACAAGGCGUNNNACTNNNTGAUCAUUAUUGUGGCCUGUUUGACUCUGT | | |
| 804 | TCTGTACGGTGACAAGGCGUNNNACTNNNTGAUUGACUCUUUACUUCAAACUCUGAGCC | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 805 | TCTGTACGGTGACAAGGCGUNNNACTNNNTGAUGUCGUCUUCGGAAAUGUUAUGAAGCA | | |
| 806 | TCTGTACGGTGACAAGGCGUNNNACTNNNTGAUGAGAGAGUACUGAAUUCUUGCAGCAG | | |
| 807 | TCTGTACGGTGACAAGGCGUNNNACTNNNTGAUACUUCAAAAUCAAGUUUGCUGAGACT | | |
| 808 | TCTGTACGGTGACAAGGCGUNNNACTNNNTGAUGCAAUUCACUAACAAGAAAACAGGGA | | |
| 809 | TCTGTACGGTGACAAGGCGUNNNACTNNNTGAUAAAUACACAGACAAACUCCAGAAAGC | | |
| 810 | TCTGTACGGTGACAAGGCGUNNNACTNNNTGAUCUACUGUUUGCUCCUAACUUGCUCUT | | |
| 811 | TCTGTACGGTGACAAGGCGUNNNACTNNNTGAUCAGAGAGGAAAGUCCCUUAUUGAUUG | | |
| 812 | TCTGTACGGTGACAAGGCGUNNNACTNNNTGAUUGAGUGGUGGAGUUCAGUUUCUAT | | |
| 813 | TCTGTACGGTGACAAGGCGUNNNACTNNNTGAUAAGACCUUGCAGAAAUAGGAAUUGCT | | |
| 814 | TCTGTACGGTGACAAGGCGUNNNACTNNNTGAUGAAGAAAAUGAAAAGGAGUUAGCAGC | | |
| 815 | TCTGTACGGTGACAAGGCGUNNNACTNNNTGAUGAGUAACACAUCUUCUCAACCAGGAC | | |
| 816 | TCTGTACGGTGACAAGGCGUNNNACTNNNTGAUUGGAUUUUUCUUACCACAACAUGACA | | |
| 817 | TCTGTACGGTGACAAGGCGUNNNACTNNNTGAUAUUUCAGUUUGCUGAAGUCAAGGAGG | | |
| 818 | TCTGTACGGTGACAAGGCGUNNNACTNNNTGAUGGAUUUCUUCUGAUGGUAGCUUUUGT | | |
| 819 | TCTGTACGGTGACAAGGCGUNNNACTNNNTGAUCAGUCUACAAAAAGACCUGCUAGAGC | | |
| 820 | TCTGTACGGTGACAAGGCGUNNNACTNNNTGAUGUGUGGAUGAAACUUUGAUGUGUUCA | | |
| 821 | TCTGTACGGTGACAAGGCGUNNNACTNNNTGAUAGAAUUAUGGACCAGACUCAGUGCCT | | |
| 822 | TCTGTACGGTGACAAGGCGUNNNACTNNNTGAUCGGGAGGAAUUCAUCAUAUUCAACAG | | |
| 823 | TCTGTACGGTGACAAGGCGUNNNACTNNNTGAUAAAAAGACAUGGAUGAAAGACGACGA | | |
| 824 | TCTGTACGGTGACAAGGCGUNNNACTNNNTGAUAGUAGGACUGUAGACAGUGAAACUUG | | |
| 825 | TCTGTACGGTGACAAGGCGUNNNACTNNNTGAUCUAUUGGGAUAUCCUUUCACUCUGCA | | |
| 826 | TCTGTACGGTGACAAGGCGUNNNACTNNNTGAUAUGAUCGGGAAACACAAAAACAUCAT | | |
| 827 | TCTGTACGGTGACAAGGCGUNNNACTNNNTGAUUUCCUAGCUGAAUGCUAUAACCUCUG | | |
| 828 | TCTGTACGGTGACAAGGCGUNNNACTNNNTGAUUUcCUGGUUAUAGGAAAUUACACUGGC | | |
| 829 | TCTGTACGGTGACAAGGCGUNNNACTNNNTGAUAUCCAAGCAAUUCUAUGCUAUACACAC | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 830 | TCTGTACGGTGACAAGGCGUNNNACTNNNTGAUCACAAAGAUUUGUGAUUUUGGUCUAGC | | |
| 831 | TCTGTACGGTGACAAGGCGUNNNACTNNNTGAUCUGACCAACUUUUCCCAGUUUCUCAAT | | |
| 832 | TCTGTACGGTGACAAGGCGUNNNACTNNNTGAUACCUUUCCUCUGGAGUAUCUACAUGAA | | |
| 833 | TCTGTACGGTGACAAGGCGUNNNACTNNNTGAUGACAGCAUCAAGCUAUGUACGUAGUUC | | |
| 834 | TCTGTACGGTGACAAGGCGUNNNACTNNNTGAUAGAUUUCUUGUUACUUUUUCCCCAGAC | | |
| 835 | TCTGTACGGTGACAAGGCGUNNNACTNNNTGAUCACUGUUGUUUCACAAGAUGAUGUUUG | | |
| 836 | TCTGTACGGTGACAAGGCGUNNNACTNNNTGAUGUUUGACAGUUAAAGGCAUUUCCUGUG | | |
| 837 | TCTGTACGGTGACAAGGCGUNNNACTNNNTGAUACCUUCGGCUUUUUCAACCCUUUUUAA | | |
| 838 | TCTGTACGGTGACAAGGCGUNNNACTNNNTGAUGGAAACAACAUUCAACUCCCUACUUUG | | |
| 839 | TCTGTACGGTGACAAGGCGUNNNACTNNNTGAUAAAUCAUCAACAUCAACAUUGCAGACT | | |
| 840 | TCTGTACGGTGACAAGGCGUNNNACTNNNTGAUGAUGGCUGAUCUUGAAGGUUUACACUT | | |
| 841 | TCTGTACGGTGACAAGGCGUNNNACTNNNTGAUCAAGUAUUACAAUAGAGCUGGGAUGGA | | |
| 842 | TCTGTACGGTGACAAGGCGUNNNACTNNNTGAUGGAGGAUCCUGUAAUUAUUGAAAGAGC | | |
| 843 | TCTGTACGGTGACAAGGCGUNNNACTNNNTGAUUAGAAGACUUGACUGGUCUUACAUUGC | | |
| 844 | TCTGTACGGTGACAAGGCGUNNNACTNNNTGAUAGGAAGAAGCAGAUCAGAUACGAAAAA | | |
| 845 | TCTGTACGGTGACAAGGCGUNNNACTNNNTGAUCACAGUAAAGAGAUUGUGGCUAUCAGC | | |
| 846 | TCTGTACGGTGACAAGGCGUNNNACTNNNTGAUCGUAUACAAAGGAAACUCAGACUCCAG | | |
| 847 | TCTGTACGGTGACAAGGCGUNNNACTNNNTGAUAAUGAAUCAUUUGGAGGUGGAUUUGCT | | |
| 848 | TCTGTACGGTGACAAGGCGUNNNACTNNNTGAUGUUCCACUUGUCAGUGAAGUUCAAAUA | | |
| 849 | TCTGTACGGTGACAAGGCGUNNNACTNNNTGAUGAAGACUUGGAUCGAAUUCUCACUCUC | | |
| 850 | TCTGTACGGTGACAAGGCGUNNNACTNNNTGAUAAAGGGAUCUUCCAGUAUGACUACCAT | | |
| 851 | TCTGTACGGTGACAAGGCGUNNNACTNNNTGAUGUAACGAAACAGACAGUCUUACAGAAG | | |
| 852 | TCTGTACGGTGACAAGGCGUNNNACTNNNTGAUUUGAAACACUCAGAAAAACAGUUGAGG | | |
| 853 | TCTGTACGGTGACAAGGCGUNNNACTNNNTGAUCUAGAGGAAGAGUUAAGAAAGGCCAAC | | |
| 854 | TCTGTACGGTGACAAGGCGUNNNACTNNNTGAUGCAGAACAGGAUAUAACUACCUUGGAG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 855 | TCTGTACGGTGACAAGGCGUNNNACTNNNTGAUGACAGUGAGAGACUUCAGUAUGAAAAA | | |
| 856 | TCTGTACGGTGACAAGGCGUNNNACTNNNTGAUGAAUUAUGAGACCUACUGAUGUCCCUG | | |
| 857 | TCTGTACGGTGACAAGGCGUNNNACTNNNTGAUAUUCCUCAGGGAAUACUUUGAGAGGUT | | |
| 858 | TCTGTACGGTGACAAGGCGUNNNACTNNNTGAUCUUUGCAAGCUGAUAAUGAUUUCACCA | | |
| 859 | TCTGTACGGTGACAAGGCGUNNNACTNNNTGAUGUUGCUCCAGCACUAAGUGUAUUUAAT | | |
| 860 | TCTGTACGGTGACAAGGCGUNNNACTNNNTGAUCCUCACUUUCAAUAUCACGAAGACCAT | | |
| 861 | TCTGTACGGTGACAAGGCGUNNNACTNNNTGAUGAAGAAACCACUGGAUGGAGAAUAUUT | | |
| 862 | TCTGTACGGTGACAAGGCGUNNNACTNNNTGAUAGAUCGGUAGCCAAGCUGGAAAAGACA | | |
| 863 | TCTGTACGGTGACAAGGCGUNNNACTNNNTGAUUGGUUACUAGUUUAGAAGAAUCCCUGA | | |
| 864 | TCTGTACGGTGACAAGGCGUNNNACTNNNTGAUCAGUUAUCCAAGUUCCCAACACAGAUC | | |
| 865 | TCTGTACGGTGACAAGGCGUNNNACTNNNTGAUUGUGGAAAAAGAUUUAGCAGGCUAGAC | | |
| 866 | TCTGTACGGTGACAAGGCGUNNNACTNNNTGAUAAGAAUGAAUCUGGCACAUGGAUUCAG | | |
| 867 | TCTGTACGGTGACAAGGCGUNNNACTNNNTGAUGCCGUGAUAGAAAAUAUACAGCGAGAA | | |
| 868 | TCTGTACGGTGACAAGGCGUNNNACTNNNTGAUUGUGGCUCAUAAAGCAUUUCUGAAAAA | | |
| 869 | TCTGTACGGTGACAAGGCGUNNNACTNNNTGAUUGCCUAUCAUAGUCAUUCAGUGAUUGUT | | |
| 870 | TCTGTACGGTGACAAGGCGUNNNACTNNNTGAUGAGUAGCUCCAAAUUAAUGAAUGUGCAT | | |
| 871 | TCTGTACGGTGACAAGGCGUNNNACTNNNTGAUUCUCAUGUCUGAACUGAAGAUAAUGACT | | |
| 872 | TCTGTACGGTGACAAGGCGUNNNACTNNNTGAUUACCCAAAUUGCUUCUGUCUGUUAAAUG | | |
| 873 | TCTGTACGGTGACAAGGCGUNNNACTNNNTGAUUAAAUGGUUUUCUUUUCUCCUCCAACCT | | |
| 874 | TCTGTACGGTGACAAGGCGUNNNACTNNNTGAUAUAGUGAUUAGUAAAGGAGCCCAAGAAT | | |
| 875 | TCTGTACGGTGACAAGGCGUNNNACTNNNTGAUAAUUAACUUACUUGCCACUGAAAAGUUG | | |
| 876 | TCTGTACGGTGACAAGGCGUNNNACTNNNTGAUCCGUGAAGAUCCCAUUGUCUAUGAAAUT | | |
| 877 | TCTGTACGGTGACAAGGCGUNNNACTNNNTGAUUCCUUCCUAGAGAGUUAGAGUAACUUCA | | |
| 878 | TCTGTACGGTGACAAGGCGUNNNACTNNNTGAUCUGUCUUUAUAUUCAUGACCUACUGGCA | | |
| 879 | TCTGTACGGTGACAAGGCGUNNNACTNNNTGAUCUGACCCCUUCCCAUCAAAAUUUUAUCT | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 880 | TCTGTACGGTGACAAGGCGUNNNACTNNNTGAUAUCCCUUUGGGUUAUAAAUAGUGCACUC | | |
| 881 | TCTGTACGGTGACAAGGCGUNNNACTNNNTGAUAUCUUGACAAAGCAAAUAAAGACAAAGC | | |
| 882 | TCTGTACGGTGACAAGGCGUNNNACTNNNTGAUUUAAGGGAAAAUGACAAAGAACAGCUCA | | |
| 883 | TCTGTACGGTGACAAGGCGUNNNACTNNNTGAUGGGAAGAAAAGUGUUUUGAAAUGUGUUT | | |
| 884 | TCTGTACGGTGACAAGGCGUNNNACTNNNTGAUUAAAUCUUUUCUCAAUGAUGCUUGGCUC | | |
| 885 | TCTGTACGGTGACAAGGCGUNNNACTNNNTGAUAAGGAACUGUGUGCAAAAUCUUCAAUUG | | |
| 886 | TCTGTACGGTGACAAGGCGUNNNACTNNNTGAUCAAGAAUAAAAUGUCUAGCAGCAAGAAG | | |
| 887 | TCTGTACGGTGACAAGGCGUNNNACTNNNTGAUAGAUCAGAUCUGGACUAUAUUAGGUCCC | | |
| 888 | TCTGTACGGTGACAAGGCGUNNNACTNNNTGAUGGAACAGAUAUCCAGAACUAGUGAACUT | | |
| 889 | TCTGTACGGTGACAAGGCGUNNNACTNNNTGAUGGUGAAGAACUUAAAACUGUGACAGAGA | | |
| 890 | TCTGTACGGTGACAAGGCGUNNNACTNNNTGAUCCUGAAAACCAAAUACGAUGAAGAAACT | | |
| 891 | TCTGTACGGTGACAAGGCGUNNNACTNNNTGAUAUGUUGACAACUAUGAUGACAUCAGAAC | | |
| 892 | TCTGTACGGTGACAAGGCGUNNNACTNNNTGAUCAUGAAGACUUCCUAGAGAAUUCACAUC | | |
| 893 | TCTGTACGGTGACAAGGCGUNNNACTNNNTGAUAUAAAGGACAAGGUAAGAAGAAGACAAG | | |
| 894 | TCTGTACGGTGACAAGGCGUNNNACTNNNTGAUGAACUGGAGAAGAUGAUGACUAUGUUGA | | |
| 895 | TCTGTACGGTGACAAGGCGUNNNACTNNNTGAUACCUGUGAAGAAAAUGUGUGUUGAUUUT | | |
| 896 | TCTGTACGGTGACAAGGCGUNNNACTNNNTGAUCUCAACAAACAGGACUAAGGAAAGGAAA | | |
| 897 | TCTGTACGGTGACAAGGCGUNNNACTNNNTGAUUCUACUCAGCUGAAAAGCAGAGUUAAAA | | |
| 898 | TCTGTACGGTGACAAGGCGUNNNACTNNNTGAUAGGUUCUCACCCAUAUAUUGAUUUUCGT | | |
| 899 | TCTGTACGGTGACAAGGCGUNNNACTNNNTGAUCAGAAAAUGAAGAGUUUGUUGAAGUGGG | | |
| 900 | TCTGTACGGTGACAAGGCGUNNNACTNNNTGAUCCAGUUCCUAGCAGAUUUAAUAGACGAG | | |
| 901 | TCTGTACGGTGACAAGGCGUNNNACTNNNTGAUGGGAAUUGGCUAUUCUUUACAACUGUAC | | |
| 902 | TCTGTACGGTGACAAGGCGUNNNACTNNNTGAUGGAUUUCAAAGUGUUACCUCAAGAAGCA | | |
| 903 | TCTGTACGGTGACAAGGCGUNNNACTNNNTGAUGGACAGAAUUGAAUCAGGGAGAUAUGAA | | |
| 904 | TCTGTACGGTGACAAGGCGUNNNACTNNNTGAUCAUAUAGUGAUCAGAGAUUAAGGCCAAG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 905 | TCTGTACGGTGACAAGGCGUNNNACTNNNTGAUAC AUAAAAUUCACAGGAAAUCAGAUCCA | | |
| 906 | TCTGTACGGTGACAAGGCGUNNNACTNNNTGAUCU UUUCAGGAGGUGUAAAACAAGAAAAA | | |
| 907 | TCTGTACGGTGACAAGGCGUNNNACTNNNTGAUUU GAAAAAUGGCAAAGAAUUCAAACCUG | | |
| 908 | TCTGTACGGTGACAAGGCGUNNNACTNNNTGAUUC UGUUCAAUUUUGUUGAGCUUCUGAAUT | | |
| 909 | TCTGTACGGTGACAAGGCGUNNNACTNNNTGAUUG AUCGGGAAGCAUAAGAAUAUCAUCAAC | | |
| 910 | TCTGTACGGTGACAAGGCGUNNNACTNNNTGAUUU AUUUAUUGGUCUCUCAUUCUCCCAUCC | | |
| 911 | TCTGTACGGTGACAAGGCGUNNNACTNNNTGAUCC CAAGUACAUAUCCUGUAAGACCAGAAT | | |
| 912 | TCTGTACGGTGACAAGGCGUNNNACTNNNTGAUGG AGCCUAAUCUUUCAUUAUUACUGGGAA | | |
| 913 | TCTGTACGGTGACAAGGCGUNNNACTNNNTGAUAA CGGGUUAUUAACAUAUUUCAGAGCAAC | | |
| 914 | TCTGTACGGTGACAAGGCGUNNNACTNNNTGAUCA AAGCAGGGAUUUCAUUCAUCAUUAAGA | | |
| 915 | TCTGTACGGTGACAAGGCGUNNNACTNNNTGAUCC UGUAAAUACGAAUCUUUCCAAAGGAGA | | |
| 916 | TCTGTACGGTGACAAGGCGUNNNACTNNNTGAUUU GAAAGCGUUUGAGAAUCUUUUAGGACA | | |
| 917 | TCTGTACGGTGACAAGGCGUNNNACTNNNTGAUAA GUUGAAGAUUUACCACUGAAACUGACA | | |
| 918 | TCTGTACGGTGACAAGGCGUNNNACTNNNTGAUCC UUUUUGGAAACAUACAGGAUAUCUACC | | |
| 919 | TCTGTACGGTGACAAGGCGUNNNACTNNNTGAUAC CAAUACUUCAGAAGACAAAUGUGAAAA | | |
| 920 | TCTGTACGGTGACAAGGCGUNNNACTNNNTGAUGA UUGAAGAAGCAUACAUGACAAAAUGUG | | |
| 921 | TCTGTACGGTGACAAGGCGUNNNACTNNNTGAUUG AUUUGGAUUUUCCUGCCUUAAGAAAAA | | |
| 922 | TCTGTACGGTGACAAGGCGUNNNACTNNNTGAUGG UACAAACAUUUCAAGAAGACAAAAGAT | | |
| 923 | TCTGTACGGTGACAAGGCGUNNNACTNNNTGAUUG UGAUAAUUUGCAACAUAGUAAGAAGGG | | |
| 924 | TCTGTACGGTGACAAGGCGUNNNACTNNNTGAUAC AGUCAGAAUAUUCCUGUUCCUACUACA | | |
| 925 | TCTGTACGGTGACAAGGCGUNNNACTNNNTGAUGU CUCAAAGUAAACUAUUGUUAGCAACCAT | | |
| 926 | TCTGTACGGTGACAAGGCGUNNNACTNNNTGAUCA AUGCAAAUUAGUUUCUUGCAAGAGAAAA | | |
| 927 | TCTGTACGGTGACAAGGCGUNNNACTNNNTGAUUG AUAAACUUCAGAAAGAACUCAAUGUACT | | |
| 928 | TCTGTACGGTGACAAGGCGUNNNACTNNNTGAUAA CUGGAGAGAUAUGUCAAGUCUUGUUUAC | | |
| 929 | TCTGTACGGTGACAAGGCGUNNNACTNNNTGAUGA UGACAAAAAGCUUCAGAGUUCUCUAAAA | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 930 | TCTGTACGGTGACAAGGCGUNNNACTNNNTGAUAUGAGAAAGAAGAAGAAUUCCUCACUAAUG | | |
| 931 | TCTGTACGGTGACAAGGCGUNNNACTNNNTGAUUGAAAAGAACAAGAGAUGAAUUGAUAGAGT | | |
| 932 | TCTGTACGGTGACAAGGCGUNNNACTNNNTGAUUAUGCAAAUUUCACAGAGCCUCAGUUUUAT | | |
| 933 | TCTGTACGGTGACAAGGCGUNNNACTNNNTGAUUAAUACCAAAAGUUACCAAAACUGCAGACA | | |
| 934 | TCTGTACGGTGACAAGGCGUNNNACTNNNTGAUGAAGAAGACCUUUCUGUGGAAAUAGAUGAC | | |
| 935 | TCTGTACGGTGACAAGGCGUNNNACTNNNTGAUUUGGAAAUUAUGGAAAUCAAGCAACUUCAA | | |
| 936 | TCTGTACGGTGACAAGGCGUNNNACTNNNTGAUAUGGAAAAGGAGCACUUAAAUAAGGUUCAG | | |
| 937 | TCTGTACGGTGACAAGGCGUNNNACTNNNTGAUUCCUUUCUUGAAAAUAAUCUUGAACAGCUC | | |
| 938 | TCTGTACGGTGACAAGGCGUNNNACTNNNTGAUCAGCUUAAAGUUGAUAAAGAGAAGUGGUUA | | |
| 939 | TCTGTACGGTGACAAGGCGUNNNACTNNNTGAUGACCGGCAAAUUAAAGCAAUUAUGAAAGAA | | |
| 940 | TCTGTACGGTGACAAGGCGUNNNACTNNNTGAUCAGCUACAUCAAUCCUUGAGUAUCCUAUUG | | |
| 941 | TCTGTACGGTGACAAGGCGUNNNACTNNNTGAUGGACUGCACUUUUAUUCAUCAAUUCAUAGA | | |
| 942 | TCTGTACGGTGACAAGGCGUNNNACTNNNTGAUCACAAGAUAAAGUGAUUUCAGGAAUAGCAA | | |
| 943 | TCTGTACGGTGACAAGGCGUNNNACTNNNTGAUGAAAAGGAAAAUCUGCAAAGAACUUUCCUG | | |
| 944 | TCTGTACGGTGACAAGGCGUNNNACTNNNTGAUAGAAGGAAUUAGAGAAUGCAAAUGACCUUC | | |
| 945 | TCTGTACGGTGACAAGGCGUNNNACTNNNTGAUAAAAAUGCAGUCAGAUAUGGAGAAAAUCCA | | |
| 946 | TCTGTACGGTGACAAGGCGUNNNACTNNNTGAUUCUACUACGAAAUUCUUAAUUCCCCUGACC | | |
| 947 | TCTGTACGGTGACAAGGCGUNNNACTNNNTGAUGGUUCCUAAUAUGUAUUGGGAUGUUGGUAA | | |
| 948 | TCTGTACGGTGACAAGGCGUNNNACTNNNTGAUGUUCUCUUCGUCAUGAUCAACAAAUAUGGT | | |
| 949 | TCTGTACGGTGACAAGGCGUNNNACTNNNTGAUACAGAAAUGGUUUCAAAUGAAUCUGUAGACT | | |
| 950 | TCTGTACGGTGACAAGGCGUNNNACTNNNTGAUUGAUCAUAUUCACUAAGCGCUACUAGAAACA | | |
| 951 | TCTGTACGGTGACAAGGCGUNNNACTNNNTGAUAACAUGUUCAUGCUGUGUAUGUAAUAGAAUG | | |
| 952 | TCTGTACGGTGACAAGGCGUNNNACTNNNTGAUAUCAUCUCUAAGGUAUCUUCUAGAUCCAACA | | |
| 953 | TCTGTACGGTGACAAGGCGUNNNACTNNNTGAUGAAAGCUUUAAAUGCACUAAAUAACCUGAGT | | |
| 954 | TCTGTACGGTGACAAGGCGUNNNACTNNNTGAUGAAUAUGAUCAACUCCUGAAAGAACACUCUG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 955 | TCTGTACGGTGACAAGGCGUNNNACTNNNTGAUCAGUUUACUCCAGUAAAAAUUGAAGGUUAUG | | |
| 956 | TCTGTACGGTGACAAGGCGUNNNACTNNNTGAUAAUAUUUGCGAUUAUUGAAGCUGCUUAAUGT | | |
| 957 | TCTGTACGGTGACAAGGCGUNNNACTNNNTGAUACACAGUUAAUAUGCCAGAAAAAGAAAGAAA | | |
| 958 | TCTGTACGGTGACAAGGCGUNNNACTNNNTGAUGAUCUGUGCUCAAUAAUCAGUUGUUAGAAAT | | |
| 959 | TCTGTACGGTGACAAGGCGUNNNACTNNNTGAUUGGAUUUGUUUCUCAUUCUCAUAUUUCACCA | | |
| 960 | TCTGTACGGTGACAAGGCGUNNNACTNNNTGAUAAAAUAAUUCUGUGGGAUCAUGAUCUGAAUC | | |
| 961 | TCTGTACGGTGACAAGGCGUNNNACTNNNTGAUAUCCGGGUAUAAUAAUGAAGUUAAAAGAGCA | | |
| 962 | TCTGTACGGTGACAAGGCGUNNNACTNNNTGAUGCUCAUAUUCUACUUCAUUCAGAAGAUCAGG | | |
| 963 | TCTGTACGGTGACAAGGCGUNNNACTNNNTGAUCCCGAUUUAAUUCACAUUUAUAAAGGCUUUG | | |
| 964 | TCTGTACGGTGACAAGGCGUNNNACTNNNTGAUGUAACUAAAUUGGAGAAAAGCAUUGAUGACT | | |
| 965 | TCTGTACGGTGACAAGGCGUNNNACTNNNTGAUGUUUUCGAAUUUCUCGAACUAAUGUAUAGAAG | | |
| 966 | TCTGTACGGTGACAAGGCGUNNNACTNNNTGAUAAAAACAAAGUGGACAACUAGAAAGAUUUUGA | | |
| 967 | TCTGTACGGTGACAAGGCGUNNNACTNNNTGAUUCUUCCUAAGUGCAAAAGAUAACUUUAUAUCA | | |
| 968 | TCTGTACGGTGACAAGGCGUNNNACTNNNTGAUGACAUAACAGUUAUGAUUUUGCAGAAAACAGA | | |
| 969 | TCTGTACGGTGACAAGGCGUNNNACTNNNTGAUCCUUUCAGAAAUUUCUUCAAAUAAACAGAACC | | |
| 970 | TCTGTACGGTGACAAGGCGUNNNACTNNNTGAUAGAAGAAUGACAAAGAUAAGAAGAUAGCUGAG | | |
| 971 | TCTGTACGGTGACAAGGCGUNNNACTNNNTGAUGAUGUAGAUUUUAAUCUGAACUUUGAACCAUC | | |
| 972 | TCTGTACGGTGACAAGGCGUNNNACTNNNTGAUAGGAGGAACUCUUUACUAUGAAGUUAAUAGAA | | |
| 973 | TCTGTACGGTGACAAGGCGUNNNACTNNNTGAUGGAGAAGACAUCAACCAAUUAAUCAUAAAUAC | | |
| 974 | TCTGTACGGTGACAAGGCGUNNNACTNNNTGAUAUUAUUUUCAUGCUUUGGAGAUUGGAUAUAGG | | |
| 975 | TCTGTACGGTGACAAGGCGUNNNACTNNNTGAUGAAUCCUUAUCAAUCAUCAAUGAAAAAGUACC | | |
| 976 | TCTGTACGGTGACAAGGCGUNNNACTNNNTGAUGAUGAUUUACUUGGAGAAGAUUUGCUAUCUGG | | |
| 977 | TCTGTACGGTGACAAGGCGUNNNACTNNNTGAUCAGGAAGAAAAUCAUCAAUUACGAAGUGAAAA | | |
| 978 | TCTGTACGGTGACAAGGCGUNNNACTNNNTGAUAGGAAGAAAUCAAGAUUCUUACUGAUAAACUC | | |
| 979 | TCTGTACGGTGACAAGGCGUNNNACTNNNTGAUUAGAACCAAUGAGAGACUAUCUCAAGAACUUG | | |

TABLE A-continued primer sequences of the oncology precision assay, FWD pool and REV pool

| SEQ ID NO | PrimerSeqFWD (A) | SEQ ID NO | PrimerSeqREV (B) |
|---|---|---|---|
| 980 | TCTGTACGGTGACAAGGCGUNNNACTNNNTGAUUAUGAUGAGACAGAUCCAUUUAUUGAUAACUC | | |
| 981 | TCTGTACGGTGACAAGGCGUNNNACTNNNTGAUAAGAACUUAAACGAAAAUUGAACAUUCUGACT | | |
| 982 | TCTGTACGGTGACAAGGCGUNNNACTNNNTGAUAGCAAGCUGGUAUUUUCAUACAAAUUCUUCUA | | |
| 983 | TCTGTACGGTGACAAGGCGUNNNACTNNNTGAUUCUAGCUACACUGAAAAAUUAUAAUGAAGUAGG | | |
| 984 | TCTGTACGGTGACAAGGCGUNNNACTNNNTGAUCAGUAAACUGACUCUAAACUUAAAAUCUUACCT | | |
| 985 | TCTGTACGGTGACAAGGCGUNNNACTNNNTGAUCAGAUAUUUAUCCAAACAUUAUUGCUAUGGGAT | | |
| 986 | TCTGTACGGTGACAAGGCGUNNNACTNNNTGAUACUAAAUAGUUUAAGAUGAGUCAUAUUUGUGGG | | |
| 987 | TCTGTACGGTGACAAGGCGUNNNACTNNNTGAUUCUCAUCUCUAAAGGAUUUAAUUACAAAGAUGC | | |
| 988 | TCTGTACGGTGACAAGGCGUNNNACTNNNTGAUCUCUAUGUAGUCUCUGAAAAUGGAAGAAAAUAT | | |
| 989 | TCTGTACGGTGACAAGGCGUNNNACTNNNTGAUCAACAAGAUAGAAGAUUUGGAGCAAGAAAUAAA | | |
| 990 | TCTGTACGGTGACAAGGCGUNNNACTNNNTGAUCAUGCAACUUACUGAAAAAUACUAUAAAUGACC | | |
| 991 | TCTGTACGGTGACAAGGCGUNNNACTNNNTGAUCCUUAUUAAAGAACUUUCUAAAGUAAUUCGAGC | | |
| 992 | TCTGTACGGTGACAAGGCGUNNNACTNNNTGAUCUCAGGACUCAUUAUUUUAACAUUUGGGAGAAA | | |
| 993 | TCTGTACGGTGACAAGGCGUNNNACTNNNTGAUGCcCUAUAUUUGCAUUAAAAUGGAAUAAGAAAG | | |
| 994 | TCTGTACGGTGACAAGGCGUNNNACTNNNTGAUGAAUUAAAUGCCCACAUAAAACUUUCUAAUUUG | | |
| 995 | TCTGTACGGTGACAAGGCGUNNNACTNNNTGAUAGUUGCUAUAUUUACACUGAUGGUAGAAAUAAA | | |
| 996 | TCTGTACGGTGACAAGGCGUNNNACTNNNTGAUCCUAUAUUACAGAUUCUAUUCAUGAACAAUGCT | | |

Each N independently is A, C, G or T

SEQUENCE LISTING (1567 sequences)

SEQ ID NO: 1 - DNA, 49 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgagucgggctcugga

SEQ ID NO: 2 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcacgggucgggugaga

SEQ ID NO: 3 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguggugccgagccucug

SEQ ID NO: 4 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggccguuagggugcag

SEQ ID NO: 5 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugccucaccuccaccgt

SEQ ID NO: 6 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguucugcgcagcuuccc

SEQ ID NO: 7 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauggccauggcgcgga

SEQ ID NO: 8 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucgucucuccagccc

SEQ ID NO: 9 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggccccugagcgucauc

SEQ ID NO: 10 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgucugaggagcccgug

SEQ ID NO: 11 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcguccucccagcgua

SEQ ID NO: 12 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcgacccccucaucat

SEQ ID NO: 13 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuuggaggaccgucgc

SEQ ID NO: 14 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugggacagugggccaa

SEQ ID NO: 15 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcugggccagagugt

SEQ ID NO: 16 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacauggccuccuccgc

SEQ ID NO: 17 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagguccccaugguggc

SEQ ID NO: 18 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggcgccuuccauggag

SEQ ID NO: 19 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugcagcaguggagcca

SEQ ID NO: 20 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccaggacgugcugcuc

SEQ ID NO: 21 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugggcaacgugguugg

SEQ ID NO: 22 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccaucgagccuccgac

SEQ ID NO: 23 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugcaaccugcagcac

SEQ ID NO: 24 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuuugguggcacgcagc

SEQ ID NO: 25 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucuuccccaacggca

SEQ ID NO: 26 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcguggagcuaugggt

SEQ ID NO: 27 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugcccccacucccag

SEQ ID NO: 28 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaggccuccugcacucc

SEQ ID NO: 29 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggacggucggacuccc

SEQ ID NO: 30 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaggcgaugucgccgaa

SEQ ID NO: 31 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcuucgaggccguuga

SEQ ID NO: 32 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcgaaggcgucucccug

SEQ ID NO: 33 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcggcuugggagaaug

SEQ ID NO: 34 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuacacggugcgcgagg

SEQ ID NO: 35 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguguccagaggacccc

SEQ ID NO: 36 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagccaugggcugcat

SEQ ID NO: 37 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggcucagugaggcucg

SEQ ID NO: 38 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugccacccgccuaug

SEQ ID NO: 39 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagugcuggcaugccg

SEQ ID NO: 40 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugguggaggaccugg

SEQ ID NO: 41 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuggcacugagggucgc

SEQ ID NO: 42 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaacccgcgcucucuga

SEQ ID NO: 43 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagcucggcuguucca

SEQ ID NO: 44 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucagagccccaccug

SEQ ID NO: 45 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgugcuggagagacccc

SEQ ID NO: 46 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggagccgucaacgaug

SEQ ID NO: 47 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgugcccuccguguuca

SEQ ID NO: 48 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccggcguccacaacuca

SEQ ID NO: 49 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggagaugccgucggug

SEQ ID NO: 50 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuggccuucguacggg

SEQ ID NO: 51 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucugccagcggcucag

SEQ ID NO: 52 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcugcaugaucugcgg

SEQ ID NO: 53 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccgucaugagacccga

SEQ ID NO: 54 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagccucucugcccagc

SEQ ID NO: 55 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguucugccucccgugg

SEQ ID NO: 56 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagccgaccuugaggcug

SEQ ID NO: 57 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccucucaugcccgcag

SEQ ID NO: 58 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucccaguggcccucgg

SEQ ID NO: 59 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaggccacugggucacc

SEQ ID NO: 60 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggagauggcccgaca

SEQ ID NO: 61 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaccgucuccucggagc

SEQ ID NO: 62 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugcucccagcaagcga

SEQ ID NO: 63 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucaccgcaucgugcag

SEQ ID NO: 64 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccgcucguccaccag

SEQ ID NO: 65 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucgcccacgaguagc

SEQ ID NO: 66 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcgccaccugcugac

SEQ ID NO: 67 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgccucucaccaucga

SEQ ID NO: 68 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucgagcccgggaagug

SEQ ID NO: 69 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggacucgauggaccgc

SEQ ID NO: 70 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacugccuggcuggcug

SEQ ID NO: 71 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugugcccaccaggcaa

SEQ ID NO: 72 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaucuccugcgcccugg

SEQ ID NO: 73 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugauugcuccggccgt

SEQ ID NO: 74 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggaggcacugaggcg

SEQ ID NO: 75 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccgccaugcaaggct

SEQ ID NO: 76 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguccagggagagccug

SEQ ID NO: 77 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccgacuccgaggacg

SEQ ID NO: 78 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcugcagaacgggag

SEQ ID NO: 79 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucguuccgcuucggg

SEQ ID NO: 80 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccagcaaggccuggug

SEQ ID NO: 81 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuagcuuuggcgaggg

SEQ ID NO: 82 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugagcuugcccugaccc

SEQ ID NO: 83 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugagggcgaugggcug

SEQ ID NO: 84 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagugagcugccugcgt

SEQ ID NO: 85 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcggcgaguccugag

SEQ ID NO: 86 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggcuccgggugacagc

SEQ ID NO: 87 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagcggacuccccucg

SEQ ID NO: 88 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccagcauccgaccac

SEQ ID NO: 89 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucccugcugucugccg

SEQ ID NO: 90 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaugcagccgugccag

SEQ ID NO: 91 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucggcagccgcagaa

SEQ ID NO: 92 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccaggagguggaggg

SEQ ID NO: 93 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuccugagccagcaggg

SEQ ID NO: 94 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccauucccgggaggg

SEQ ID NO: 95 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggcuccaccucagcag

SEQ ID NO: 96 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaagucagccggcuc

SEQ ID NO: 97 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaggacgccuucugca

SEQ ID NO: 98 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugcccaggcugggaag

SEQ ID NO: 99 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucaccacgagcugcc

SEQ ID NO: 100 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuggaccagacccugc

SEQ ID NO: 101 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaugagucggccugugg

SEQ ID NO: 102 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccacccuuccgaccuc

SEQ ID NO: 103 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuucccgggucccgag

SEQ ID NO: 104 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggugggcagccaggag

SEQ ID NO: 105 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaggcuuugguccagcca

SEQ ID NO: 106 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugagugggcaggaggc

SEQ ID NO: 107 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaguggaggccggaug

SEQ ID NO: 108 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccucgggcagugacac

SEQ ID NO: 109 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagccgugcagcgauug

SEQ ID NO: 110 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcccacugugcuuccuc

SEQ ID NO: 111 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguucgcgcacacccua

SEQ ID NO: 112 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcgucugcuguugct

SEQ ID NO: 113 - DNA, 50 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaacggcagcuucgug

SEQ ID NO: 114 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguggcccuguaggacct

SEQ ID NO: 115 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgaaugcgccccggacut

SEQ ID NO: 116 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagcugguggaggcugac

SEQ ID NO: 117 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugcccgugaaguggat

SEQ ID NO: 118 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuguccuccacaggcat

SEQ ID NO: 119 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugacccggagcacuucc

SEQ ID NO: 120 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccugcaacugcuuccct

SEQ ID NO: 121 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagagugggcgaguuugc

SEQ ID NO: 122 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggcuccugaccuggagt

SEQ ID NO: 123 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggcccucccagaagguc

SEQ ID NO: 124 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugccugacauccacggt

SEQ ID NO: 125 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggcaugguccaccacag

SEQ ID NO: 126 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauggcacagccucccut

SEQ ID NO: 127 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacacagcugggcgcuuug

SEQ ID NO: 128 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucaggcgccaaguaggt

SEQ ID NO: 129 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucaccaugcugcagcac

SEQ ID NO: 130 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuagauggacgcacugggc

SEQ ID NO: 131 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaagccggcuacgcgcug

SEQ ID NO: 132 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccagccccuccucagaug

SEQ ID NO: 133 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucugugacaacgggcugc

SEQ ID NO: 134 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguggacagcaucgggagc

SEQ ID NO: 135 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaacaggagcagcugcg

SEQ ID NO: 136 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucuccugugugcccaga

SEQ ID NO: 137 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccccaaguccuccuugcc

SEQ ID NO: 138 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacagacaggcugugugc

SEQ ID NO: 139 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccugccaagaaggcca

SEQ ID NO: 140 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccacaagucggaccccua

SEQ ID NO: 141 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcggaucuggaggagcag

SEQ ID NO: 142 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagugcggaagauugccc

SEQ ID NO: 143 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacacguucacggugccc

SEQ ID NO: 144 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggaggaagcccaucga

SEQ ID NO: 145 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugggcucuuaccgcaag

SEQ ID NO: 146 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccccaagagugccaagug

SEQ ID NO: 147 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucgucugucacccagg

SEQ ID NO: 148 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaccagacggucucaga

SEQ ID NO: 149 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccccaaccgcacugag

SEQ ID NO: 150 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagugacggaggagcuugt

SEQ ID NO: 151 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauggcacucagcagcaag

SEQ ID NO: 152 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugguggccauaggaacg

SEQ ID NO: 153 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaaacccagugcguacgcat

SEQ ID NO: 154 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugaagagcacgccaug

SEQ ID NO: 155 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcugcacguuuccucc

SEQ ID NO: 156 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcaccagcucacugcac

SEQ ID NO: 157 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucguggccuugaccucc

SEQ ID NO: 158 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagcugguggaagacct

SEQ ID NO: 159 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacgacuccguguuugcc

SEQ ID NO: 160 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcucacagucuccuggg

SEQ ID NO: 161 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaaccuccgugaggacg

SEQ ID NO: 162 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcugguguugcugaggg

SEQ ID NO: 163 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacagugcccagggcuc

SEQ ID NO: 164 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggccugcucuuccuuggg

SEQ ID NO: 165 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuggguuucgaggccaac

SEQ ID NO: 166 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggcuuuccuccugcguc

SEQ ID NO: 167 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaugcugggacgcugcc

SEQ ID NO: 168 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccaccaccacuucccc

SEQ ID NO: 169 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggagauccacgccuacc

SEQ ID NO: 170 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcgaagcuucgagaccug

SEQ ID NO: 171 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucagaggaggucguggg

SEQ ID NO: 172 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggcaagcuccuuccug

SEQ ID NO: 173 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugccgagaagccaguca

SEQ ID NO: 174 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcaacggaagcacugg

SEQ ID NO: 175 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguggaguggcagcagaag

SEQ ID NO: 176 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuggaggagcagcuuga

SEQ ID NO: 177 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuccgagccaaucacggg

SEQ ID NO: 178 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaucuccuacgcccugg

SEQ ID NO: 179 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccaccugcuccuuccag

SEQ ID NO: 180 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagacacggugguacuggc

SEQ ID NO: 181 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgauugcagcucaugct

SEQ ID NO: 182 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucuggaagccaaggcag

SEQ ID NO: 183 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauuggccaaggagugcc

SEQ ID NO: 184 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuggcggagcagaugag

SEQ ID NO: 185 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauacccggacccuggag

SEQ ID NO: 186 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagaucgccgcccucaut

SEQ ID NO: 187 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcacgcagcccaaauc

SEQ ID NO: 188 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacauccuguugcacccca

SEQ ID NO: 189 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucgccaccuccaaccauc

SEQ ID NO: 190 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggugcgcaaggugaaat

SEQ ID NO: 191 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuugcuggaugggccug

SEQ ID NO: 192 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaaggagggucaccgc

SEQ ID NO: 193 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagugugccaguagccgug

SEQ ID NO: 194 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaucuggagcuccguga

SEQ ID NO: 195 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagaacguggugggcat

SEQ ID NO: 196 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucugaagaccggccac

SEQ ID NO: 197 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccccaacaggcaggug

SEQ ID NO: 198 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggcauggaguacuuggc

SEQ ID NO: 199 - DNA, 51 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcagugucaugggcaag

SEQ ID NO: 200 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggugucuguccugggagt

SEQ ID NO: 201 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugugcuuuuagggcccacc

SEQ ID NO: 202 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaagcccgcucaugaucaa

SEQ ID NO: 203 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggcacugggucaaaguct

SEQ ID NO: 204 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucaagaaucgcccgagcc

SEQ ID NO: 205 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaugggacccacuccat

SEQ ID NO: 206 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccaaaauggcccgagac

SEQ ID NO: 207 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcagggcuucuucagca

SEQ ID NO: 208 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcgggacauggacucaac

SEQ ID NO: 209 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcauguacuggucccgcat

SEQ ID NO: 210 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggaaugccaacccaugga

SEQ ID NO: 211 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaggcgaggagcuccaguc

SEQ ID NO: 212 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugaggcuccccuuucut

SEQ ID NO: 213 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcccucugacguccauc

SEQ ID NO: 214 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggugcccaucaaguggat

SEQ ID NO: 215 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuccagcuucuucugca

SEQ ID NO: 216 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcgggcuugguucugaugt

SEQ ID NO: 217 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguccugaagcaggucaac

SEQ ID NO: 218 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggugagggugucucucug

SEQ ID NO: 219 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguaaauacgggcccgacg

SEQ ID NO: 220 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuccccuccauugugggc

SEQ ID NO: 221 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccauccgaaagcaguccaa

SEQ ID NO: 222 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagggcaggagucaagaugc

SEQ ID NO: 223 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugggccccuggauggaua

SEQ ID NO: 224 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguagcagccgucugucuc

SEQ ID NO: 225 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguacacacugcagcccaag

SEQ ID NO: 226 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuacuaucccucgggaggc

SEQ ID NO: 227 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuuaaggccccagcguc

SEQ ID NO: 228 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccggauucgcaugugug

SEQ ID NO: 229 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccagcuccucugacagc

SEQ ID NO: 230 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucuccaccccagcaaaac

SEQ ID NO: 231 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucauucaugccccuccugg

SEQ ID NO: 232 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaagugcaaggcacugc

SEQ ID NO: 233 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucacgugcagcacaugg

SEQ ID NO: 234 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguuucacgccaccaacut

SEQ ID NO: 235 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuucugggcuggguguga

SEQ ID NO: 236 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacgcuggccuauaaggugc

SEQ ID NO: 237 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugaccucccagaccgag

SEQ ID NO: 238 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugggcaucacuguccucg

SEQ ID NO: 239 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuugagcagcagcugag

SEQ ID NO: 240 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacagcucucugugaugcg

SEQ ID NO: 241 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacgacgggaggacaaucuc

SEQ ID NO: 242 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggcugcaggacuaugagg

SEQ ID NO: 243 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccuugagcaucgcaucca

SEQ ID NO: 244 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagggacgugaacggagug

SEQ ID NO: 245 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacacccccagcuccagcuc

SEQ ID NO: 246 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccuuucgagcaguacucc

SEQ ID NO: 247 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacaguacccggcuguaga

SEQ ID NO: 248 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguggccauaaagggcaacc

SEQ ID NO: 249 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucagcccagaccauucag

SEQ ID NO: 250 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcucaggcuacaucucgc

SEQ ID NO: 251 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggaccacggcaaagaug

SEQ ID NO: 252 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaguggacguggauuuggg

SEQ ID NO: 253 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaucacagagcgaagcug

SEQ ID NO: 254 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguguugugauccgccact

SEQ ID NO: 255 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuucugggacucaugccct

SEQ ID NO: 256 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccgcgacgacaagaucug

SEQ ID NO: 257 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucuacagcccagcccag

SEQ ID NO: 258 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguggccaacauucagcagc

SEQ ID NO: 259 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugguucucuccaucgccut

SEQ ID NO: 260 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucagcugcuuccguugcuc

SEQ ID NO: 261 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuccgaggcuggaaugga

SEQ ID NO: 262 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucagaaguccagcaggc

SEQ ID NO: 263 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaggcugucagagcaggag

SEQ ID NO: 264 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugacgagaucgccaacag

SEQ ID NO: 265 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggaggaagccauggagc

SEQ ID NO: 266 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucugauggcuugaaggcg

SEQ ID NO: 267 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagguguuugcugacgucca

SEQ ID NO: 268 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguacaaccagcccuccgac

SEQ ID NO: 269 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagccagaguccgucaucg

SEQ ID NO: 270 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugguaccagcucuccaa

SEQ ID NO: 271 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaccuuacugcccaggug

SEQ ID NO: 272 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacccgccagcauccuuag

SEQ ID NO: 273 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggacugcucagggugcc

SEQ ID NO: 274 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagccugucaugagaccucc

SEQ ID NO: 275 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgcucuuuccagcuggcua

SEQ ID NO: 276 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacgagguuccgguguguc

SEQ ID NO: 277 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucccaggaccuccacua

SEQ ID NO: 278 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcgacacacuguaggcagt

SEQ ID NO: 279 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccugggaaccuacugugg

SEQ ID NO: 280 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugaagcuggacuaccgc

SEQ ID NO: 281 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguggaccucagcagcaut

SEQ ID NO: 282 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccguggcuaugccuucat

SEQ ID NO: 283 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagggauuccucuucccc

SEQ ID NO: 284 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauggcacggaacugaacca

SEQ ID NO: 285 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuggagaaccaggaccut

SEQ ID NO: 286 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuugaccgcaagcuccucc

SEQ ID NO: 287 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccuugcaagcuggucaut

SEQ ID NO: 288 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugggacucguacgagaa

SEQ ID NO: 289 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggcaugacaugcagact

SEQ ID NO: 290 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcccuuagagagcuuggg

SEQ ID NO: 291 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgcauacccgccaucuuct

SEQ ID NO: 292 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcggauacaaaggcgac

SEQ ID NO: 293 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaagcuguggcuggaaaca

SEQ ID NO: 294 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaucugcuccggcuuagc

SEQ ID NO: 295 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcgacgacuuuaucugggc

SEQ ID NO: 296 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagugactgcugccacaac

SEQ ID NO: 297 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuguacauccugguuggg

SEQ ID NO: 298 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaacccaaccgugugacc

SEQ ID NO: 299 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccaagccugucaccguag

SEQ ID NO: 300 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacggcacacccuacguua

SEQ ID NO: 301 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugagugccacaaccuccug

SEQ ID NO: 302 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauggcucccagcuucct

SEQ ID NO: 303 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuggauccucacagagct

SEQ ID NO: 304 - DNA, 52 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacgaagugagucccaca

SEQ ID NO: 305 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaacgggaagcccucauguc

SEQ ID NO: 306 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggacucuggaucccagaag

SEQ ID NO: 307 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccuccuucuggccaccaug

SEQ ID NO: 308 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugugcuggacacgacaacaa

SEQ ID NO: 309 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagacccugaaggaugccagt

SEQ ID NO: 310 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgaucguuugcaaccugcuc

SEQ ID NO: 311 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacaggcuauguccucgug

SEQ ID NO: 312 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcacaagaggcccuagaut

SEQ ID NO: 313 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuaccugaccgacguuga

SEQ ID NO: 314 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggaccagcucuuucggaac

SEQ ID NO: 315 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugaaggugcuuggaucug

SEQ ID NO: 316 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuucagcaggaaguaccgt

SEQ ID NO: 317 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugagguggaagagacaggc

SEQ ID NO: 318 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggaggagcucuucaagcug

SEQ ID NO: 319 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagacccaagcugccugac

SEQ ID NO: 320 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcuguugugaaaaggacgg

SEQ ID NO: 321 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugugcuacauacgggcugaa

SEQ ID NO: 322 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggccauuggcucuauggaa

SEQ ID NO: 323 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaggcuaucacaagcugcac

SEQ ID NO: 324 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaugucuggcugugaugct

SEQ ID NO: 325 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugacguaccaaacaggcac

SEQ ID NO: 326 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccgguucccacugaugaca

SEQ ID NO: 327 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucauucagcaccagaggca

SEQ ID NO: 328 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagcugcucaguuacagcag

SEQ ID NO: 329 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaaucucuggccaacuccg

SEQ ID NO: 330 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaugcagaaugccaccaag

SEQ ID NO: 331 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcacuccuuggagcaaaagc

SEQ ID NO: 332 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuguuggccuggcagaaaa

SEQ ID NO: 333 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagaaggagauugcccugct

SEQ ID NO: 334 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucacaguuugaggcacagg

SEQ ID NO: 335 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccucucauugaccggaacc

SEQ ID NO: 336 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcucucaucggccaauca

SEQ ID NO: 337 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuucuggaccaagacgact

SEQ ID NO: 338 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccccauccagaccuacucug

SEQ ID NO: 339 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugccgcuaaagaaggguc

SEQ ID NO: 340 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggcaucucucgcugguut

SEQ ID NO: 341 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggugucauccagccuuagc

SEQ ID NO: 342 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauaccagaggcaauccgca

SEQ ID NO: 343 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacagccggaggucauacug

SEQ ID NO: 344 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggauaguggaucccaacgg

SEQ ID NO: 345 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccagcagaggcauaagguuc

SEQ ID NO: 346 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaaacgccuguguuccacc

SEQ ID NO: 347 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuccggcaaaucacagaucg

SEQ ID NO: 348 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucuccgguguggaguucug

SEQ ID NO: 349 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcaacauugaaagccucgt

SEQ ID NO: 350 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacacaagggagguccucaa

SEQ ID NO: 351 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacgacgaggaugaggaug

SEQ ID NO: 352 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgaacagaaaccccuccuc

SEQ ID NO: 353 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccugcauccaauggaugct

SEQ ID NO: 354 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucucuucauggccagugc

SEQ ID NO: 355 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauggagaggcugaagcag

SEQ ID NO: 356 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgaagccaucaaacagcugc

SEQ ID NO: 357 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuacauacccagcaccga

SEQ ID NO: 358 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccuugugucaauggaggca

SEQ ID NO: 359 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacagcaucaaggaugugca

SEQ ID NO: 360 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccaauaccugcagcuucug

SEQ ID NO: 361 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacuaccaggauugccaacc

SEQ ID NO: 362 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggauggaaacuuugcugct

SEQ ID NO: 363 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguuggagcccauucagagc

SEQ ID NO: 364 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucgcucaccuggaugacaa

SEQ ID NO: 365 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugaggaguacguggaggug

SEQ ID NO: 366 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucuccuuggccucuccug

SEQ ID NO: 367 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcccaacacuguaccucag

SEQ ID NO: 368 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgggcaggaaucugaugac

SEQ ID NO: 369 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagggcagcaacaucuuug

SEQ ID NO: 370 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucugcaacagcagcacaaa

SEQ ID NO: 371 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcugcaauuccucgaacg

SEQ ID NO: 372 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggccucacuaaacuguugg

SEQ ID NO: 373 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugaaggagcuggagaagca

SEQ ID NO: 374 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggaggaaaaggucgccuc

SEQ ID NO: 375 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaauuuagaagggcugguggc

SEQ ID NO: 376 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaaacccccuacagauggc

SEQ ID NO: 377 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaccagugggagggucuuat

SEQ ID NO: 378 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaucugcaacagcaagcac

SEQ ID NO: 379 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguacaauguccuccugacagc

SEQ ID NO: 380 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugaagacaggcccaacut

SEQ ID NO: 381 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacgaggcugcaagagagauc

SEQ ID NO: 382 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggcacccgaggcauuauut

SEQ ID NO: 383 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagaaugaguacggcagca

SEQ ID NO: 384 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucggacucucccaucacucug

SEQ ID NO: 385 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugcugaaggaaggacaca

SEQ ID NO: 386 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcaugagacucagugcaga

SEQ ID NO: 387 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagacucugcuucgcugcat

SEQ ID NO: 388 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggauagccuccaccacct

SEQ ID NO: 389 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugugaauuagggaccggga

SEQ ID NO: 390 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccucaaggagcccuuucca

SEQ ID NO: 391 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacccccaguacuuccguca

SEQ ID NO: 392 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgagugcuacaaccucagcc

SEQ ID NO: 393 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauucagcccagagccuuug

SEQ ID NO: 394 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaucugaaaggcagagcagg

SEQ ID NO: 395 - DNA, 53 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaccuacucccucuccguga

SEQ ID NO: 396 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccacugcugugucuguaaacg

SEQ ID NO: 397 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucucugcgcauucaggagug

SEQ ID NO: 398 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguaccagauggaugugaacc

SEQ ID NO: 399 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugggaccuccggucagaaaac

SEQ ID NO: 400 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccacacgcaacugucuagugg

SEQ ID NO: 401 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccuacagauugcgagagagc

SEQ ID NO: 402 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuccugugcaugaaagcact

SEQ ID NO: 403 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccucugucaccaggacauuc

SEQ ID NO: 404 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacuuggcagccagaaacauc

SEQ ID NO: 405 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccacgugaccuugaagcuc

SEQ ID NO: 406 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucguguucuucauucggcac

SEQ ID NO: 407 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugguucuggaucagcuggaug

SEQ ID NO: 408 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacacucuugagggccacaaa

SEQ ID NO: 409 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuccucaggagucuccacat

SEQ ID NO: 410 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggauacuuacgcgccacagag

SEQ ID NO: 411 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugaugagcagcagcgaaag

SEQ ID NO: 412 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucaagcccuccaacauccua

SEQ ID NO: 413 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacugacaaccacccuuaaccc

SEQ ID NO: 414 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacccucucagcguacccuug

SEQ ID NO: 415 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuugcuggcugcaagaagat

SEQ ID NO: 416 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcacucaccauguguuccaug

SEQ ID NO: 417 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucguacaugaccacaccca

SEQ ID NO: 418 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaacguuaggugggacaguac

SEQ ID NO: 419 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucaagaggcaguuucuggca

SEQ ID NO: 420 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguuagucacuggcagcaaca

SEQ ID NO: 421 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacaacgugaugaagaucgca

SEQ ID NO: 422 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucugccucuucuucuccag

SEQ ID NO: 423 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucuuuagccauggcaagguc

SEQ ID NO: 424 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccacggaguguaugaccac

SEQ ID NO: 425 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucagucacugggagaagaa

SEQ ID NO: 426 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccggcuuuacaccaaaagc

SEQ ID NO: 427 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucccugcacucucaucgct

SEQ ID NO: 428 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagauccaaccaaugguggaca

SEQ ID NO: 429 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguuuaauaacccagccacgg

SEQ ID NO: 430 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaguccucucggaagguagc

SEQ ID NO: 431 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaagaagcaacugagagcug

SEQ ID NO: 432 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagcucccagaaguugacag

SEQ ID NO: 433 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucaggcauugcuacucugg

SEQ ID NO: 434 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguaguagacaucacucgcac

SEQ ID NO: 435 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcaucuagucuuuccgcuuc

SEQ ID NO: 436 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguauggcacaaucagagcugt

SEQ ID NO: 437 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaagaucauguggccucagt

SEQ ID NO: 438 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugcuuuggagcagaagaagg

SEQ ID NO: 439 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguugcaaagacacaaguggg

SEQ ID NO: 440 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucggaaccuuucuuccccug

SEQ ID NO: 441 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucaacgaaaagagcuaccgc

SEQ ID NO: 442 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacccugacuuccagaaaacca

SEQ ID NO: 443 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcacugcucucagugagaag

SEQ ID NO: 444 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggauuaugggcaucccagaag

SEQ ID NO: 445 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaaauauugggcccuuccug

SEQ ID NO: 446 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacugaagcugucaggacaga

SEQ ID NO: 447 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguuggcuaccuugggacauc

SEQ ID NO: 448 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugcaucucuugucgcaggut

SEQ ID NO: 449 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaacugugaggauguggcuga

SEQ ID NO: 450 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguaaucaagcagcagccaga

SEQ ID NO: 451 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuauugggacuccucugcccug

SEQ ID NO: 452 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaagcugguuuugaagucgc

SEQ ID NO: 453 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucagagagagcagcuuugug

SEQ ID NO: 454 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcauucagcuccucuguguut

SEQ ID NO: 455 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguugaagagauuggcugguc

SEQ ID NO: 456 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacaacugcuaccaugagggc

SEQ ID NO: 457 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugugggaacgugaaacauct

SEQ ID NO: 458 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucacaucuucaggugccuc

SEQ ID NO: 459 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaucuacaagaaagccccca

SEQ ID NO: 460 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccagguaccaccuuauccaca

SEQ ID NO: 461 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaccuggacaagcacauggag

SEQ ID NO: 462 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagucucuugcaaucggcua

SEQ ID NO: 463 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcccgggaauuucuucgaaaa

SEQ ID NO: 464 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacuucagugggcaucgagat

SEQ ID NO: 465 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucacagacuguuuccacucct

SEQ ID NO: 466 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguagaggaugccgaggagaa

SEQ ID NO: 467 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccugugaucgcacugacac

SEQ ID NO: 468 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugcauccuuggcagaaagug

SEQ ID NO: 469 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaacaaccuguuggagcacat

SEQ ID NO: 470 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccagugcaagacugagacuc

SEQ ID NO: 471 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuccaucagugaccugaag

SEQ ID NO: 472 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagaggccuucauggaaggaa

SEQ ID NO: 473 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugacuuccaccaggacugug

SEQ ID NO: 474 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugaccagugcuacguuucct

SEQ ID NO: 475 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccacauggcggagaguuuua

SEQ ID NO: 476 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacugugccacuucagugugc

SEQ ID NO: 477 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguucagugccaucauccugg

SEQ ID NO: 478 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucccuuccacagacgucact

SEQ ID NO: 479 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaccggagccuggaccauag

SEQ ID NO: 480 - DNA, 54 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacgcucuggagucucucucc

SEQ ID NO: 481 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguagagcaaauccauccccaca

SEQ ID NO: 482 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucgagccaccaauuucauaggc

SEQ ID NO: 483 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucccaaccaagcucucuugag

SEQ ID NO: 484 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggguauucgaugaucccugugg

SEQ ID NO: 485 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccccaaugaccugcugaaat

SEQ ID NO: 486 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagaagcaucucaccgaaaucc

SEQ ID NO: 487 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuaugguggugccgacuacaag

SEQ ID NO: 488 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucuaccagcucaccaagcuc

SEQ ID NO: 489 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacccccacugaaccucucuua

SEQ ID NO: 490 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaauccccacaccaaguauca

SEQ ID NO: 491 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagccugaagauccuaccugag

SEQ ID NO: 492 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgcaauccggaaccagaucaua

SEQ ID NO: 493 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacuaggcgugggauguuuut

SEQ ID NO: 494 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuccacacgcaaauuuccuuc

SEQ ID NO: 495 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugcagcaaagacugguucuca

SEQ ID NO: 496 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggaauaaccagcuguccucct

SEQ ID NO: 497 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagguauucucggagguugccut

SEQ ID NO: 498 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuucccucgggaaaaacugac

SEQ ID NO: 499 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccaagcacauggaucagugut

SEQ ID NO: 500 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaguacaauugcaggcugaacg

SEQ ID NO: 501 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaagcccacauaucaggaccga

SEQ ID NO: 502 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaccuggacaccuuguuagat

SEQ ID NO: 503 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucuggaucugcagcucuaugg

SEQ ID NO: 504 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuacagagacacaacccaut

SEQ ID NO: 505 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaaucgcaagagaagcaccut

SEQ ID NO: 506 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccggcucuuuccacuaaaccag

SEQ ID NO: 507 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcaguguuuagcauucuuggg

SEQ ID NO: 508 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcaaaacuacuguagagccca

SEQ ID NO: 509 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccuuuugcuccugguggaac

SEQ ID NO: 510 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacauguuggaugugaaggagc

SEQ ID NO: 511 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccaccaaagucaccagaggg

SEQ ID NO: 512 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucuuauagcggaagaggcaga

SEQ ID NO: 513 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagccauggacacacucaaga

SEQ ID NO: 514 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucuucuccaucguccaugac

SEQ ID NO: 515 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagauuccucauggucauggg

SEQ ID NO: 516 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaagaacuaguccagcuucga

SEQ ID NO: 517 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaccugcgcaaacucuuuguuc

SEQ ID NO: 518 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaaguuggugaaaaggcuugg

SEQ ID NO: 519 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaguugacccugggucugauc

SEQ ID NO: 520 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaggaaaagaggaugcuggag

SEQ ID NO: 521 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaacguaaaaugugucgcucc

SEQ ID NO: 522 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaugugcugaaaauccgaagug

SEQ ID NO: 523 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuaaugccucagaaaccaca

SEQ ID NO: 524 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuucuuggccaagaggaagac

SEQ ID NO: 525 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuggagaugguuucacagcac

SEQ ID NO: 526 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaaucucccaggcgguauuug

SEQ ID NO: 527 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgcacugccccaaguuuuacua

SEQ ID NO: 528 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagacgaaaacucugcggaag

SEQ ID NO: 529 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauccucuucccucagcuucc

SEQ ID NO: 530 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagaucacugaugaccugcact

SEQ ID NO: 531 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccuucaaugcacugauacaca

SEQ ID NO: 532 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaugucagcguuuggcuuaaca

SEQ ID NO: 533 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaccauauacaggagcucaga

SEQ ID NO: 534 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucuuuggaaccacaccagaa

SEQ ID NO: 535 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugauagcugcacugaguguca

SEQ ID NO: 536 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccuggauccacaggaaagaa

SEQ ID NO: 537 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacuugcuucugcacuagaca

SEQ ID NO: 538 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaugaccuggaagauggaguct

SEQ ID NO: 539 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuggaagaagcugaaaaagc

SEQ ID NO: 540 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagagaacgguugcaaaacug

SEQ ID NO: 541 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuacagugaugcccacuaca

SEQ ID NO: 542 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucaaacagaacgguccaguc

SEQ ID NO: 543 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucagcuagaagagaagcagc

SEQ ID NO: 544 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggagugauuugcgccaucauc

SEQ ID NO: 545 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucccccugauagcagauuugat

SEQ ID NO: 546 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauaccagcugaagagcgacaag

SEQ ID NO: 547 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaacauucgucucggaaaccc

SEQ ID NO: 548 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuggugauuuuggcaugagcag

SEQ ID NO: 549 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccgagauuggagccuaacagt

SEQ ID NO: 550 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcaagaauauuccccuggca

SEQ ID NO: 551 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucauuugccuggcagaucuc

SEQ ID NO: 552 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacaucagcaaagaccuggaga

SEQ ID NO: 553 - DNA, 55 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaacuugcuggugaaaaucgg

SEQ ID NO: 554 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucauccugcacgaacagaaaga

SEQ ID NO: 555 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccaggcacuugaugauacucac

SEQ ID NO: 556 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccucucucucuugucacguagc

SEQ ID NO: 557 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggccauuucuguuuuccuguagc

SEQ ID NO: 558 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucgccuguccucauguauugg

SEQ ID NO: 559 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccgggcuuuacgcaaauaagt

SEQ ID NO: 560 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggauuugacccuccaugaucag

SEQ ID NO: 561 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucuguacagcaugaagugcaag

SEQ ID NO: 562 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagucgucagccugaacauaacat

SEQ ID NO: 563 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcuucucagaugaaaccaccag

SEQ ID NO: 564 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcugcaccuugacuuuaagugag

SEQ ID NO: 565 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgagaauggucauaaaugugca

SEQ ID NO: 566 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacuauggagcucucacaugugg

SEQ ID NO: 567 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacccgaagaaagagacucuggaa

SEQ ID NO: 568 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucacauugccccugacaacaua

SEQ ID NO: 569 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaagggaccagggucuaugaagc

SEQ ID NO: 570 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguguccuuucaggaugguggaug

SEQ ID NO: 571 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaggaagagcacagucacuuug

SEQ ID NO: 572 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaugcccccaagaauccuaguag

SEQ ID NO: 573 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccucaacccucuucucaucagg

SEQ ID NO: 574 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucuuugaggugaagccaaacct

SEQ ID NO: 575 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccccuaccuagacccuccuaac

SEQ ID NO: 576 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuccagaagcccuguuugauag

SEQ ID NO: 577 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucauuccugugucgucuagccut

SEQ ID NO: 578 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguuauuaugaggaagcugugcc

SEQ ID NO: 579 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuugaacuccaagcugcucaag

SEQ ID NO: 580 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacgucauggaguauauguguggg

SEQ ID NO: 581 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacuaccaccuguccuacaccug

SEQ ID NO: 582 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguugguaucccuucaggacuagg

SEQ ID NO: 583 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucagcagacaauaucggaucga

SEQ ID NO: 584 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuuggagaagcugagagaaaac

SEQ ID NO: 585 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccaggucaugaaggaguacuug

SEQ ID NO: 586 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccuucaugagcugcaaucuca

SEQ ID NO: 587 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguuucaguaucccugcuccaaa

SEQ ID NO: 588 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagaugucaucaucaaccaagca

SEQ ID NO: 589 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuccauguucuuggccaugcua

SEQ ID NO: 590 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagcugguucacaugaucaact

SEQ ID NO: 591 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauauuucuuccgcaagugugucc

SEQ ID NO: 592 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaacucgaacugauuucuccugg

SEQ ID NO: 593 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggcgcugucaacagaaagaaaaa

SEQ ID NO: 594 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaacguucaagcaguugguaga

SEQ ID NO: 595 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaccaagaggaaguuggaggug

SEQ ID NO: 596 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguagaggagguguuugauguuc

SEQ ID NO: 597 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauccuccuugcuuaccacacac

SEQ ID NO: 598 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcccuucgagagcaaguuuaaga

SEQ ID NO: 599 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaagugacucuucagaucccugc

SEQ ID NO: 600 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaugaaagggaguuugguucug

SEQ ID NO: 601 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugcuaaaagagagggagagugat

SEQ ID NO: 602 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaggaacuggacuuccagaaga

SEQ ID NO: 603 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugggaucuucguagcaucaguug

SEQ ID NO: 604 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagaaccauccaccaacauaag

SEQ ID NO: 605 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaguuaaaugcccucaagucga

SEQ ID NO: 606 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggguuuuuccuguggcugaaaa

SEQ ID NO: 607 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggacugggugaaugcuauugag

SEQ ID NO: 608 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccagggaugagcagaaugaaga

SEQ ID NO: 609 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagacgguccguaaacugaaaaa

SEQ ID NO: 610 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagggauauaucccccaaaggat

SEQ ID NO: 611 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguuauuaaggagcuucgcaagg

SEQ ID NO: 612 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcauguccagagaugucuacagc

SEQ ID NO: 613 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccguauuugaagccucaggaac

SEQ ID NO: 614 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccagaaguccagagcugagaag

SEQ ID NO: 615 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuagacaucuucucccucccuug

SEQ ID NO: 616 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaucgcaggagagacugugauuc

SEQ ID NO: 617 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcagaugaaucaccuuucgut

SEQ ID NO: 618 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaggaugcucaaaggguuuut

SEQ ID NO: 619 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggcuccugagaccuuugauaac

SEQ ID NO: 620 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaugagcaagaccuaaaugagc

SEQ ID NO: 621 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuauuguaagcaggcgauguugt

SEQ ID NO: 622 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuagcuguugaaggaaaacga

SEQ ID NO: 623 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaauuuccugaagaacguuggg

SEQ ID NO: 624 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacgugaaggaugacaucuuccg

SEQ ID NO: 625 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugccuuugaaaaucaacgacaa

SEQ ID NO: 626 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccuaaagaccauugcacuucg

SEQ ID NO: 627 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugucagggaacaggaagaaut

SEQ ID NO: 628 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaauaaaacuuugcugccaccugt

SEQ ID NO: 629 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacaacaggaguugccauuccat

SEQ ID NO: 630 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugauccuaguuucugggcucaa

SEQ ID NO: 631 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucaggaagaggaagaguccaca

SEQ ID NO: 632 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaagagggacugccauaacauuc

SEQ ID NO: 633 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacugccuucugaaagguggaauc

SEQ ID NO: 634 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugggaauugacaaagacaagcc

SEQ ID NO: 635 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagcccaaagaugagagugaut

SEQ ID NO: 636 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguuucagacgcugaaggauuut

SEQ ID NO: 637 - DNA, 56 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauguggacuggauagucacug

SEQ ID NO: 638 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuauuaacuccgagcacuuagcga

SEQ ID NO: 639 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguaucuucuagcucucugccuacc

SEQ ID NO: 640 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacagccaucaucaaagagaucg

SEQ ID NO: 641 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauugugaagaucugugacuuuggc

SEQ ID NO: 642 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagcgaauuccuuuggaaaaccug

SEQ ID NO: 643 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuauccagugugcccacuacauuga

SEQ ID NO: 644 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucuuuuucagagugcaaccagca

SEQ ID NO: 645 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugcaagcaaaaaguuuguccac

SEQ ID NO: 646 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuugguguagcacugacauucat

SEQ ID NO: 647 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugggucacuguaugggauguag

SEQ ID NO: 648 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucugauuugccaaguugcucucut

SEQ ID NO: 649 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuuuucuguccaccagggaguaac

SEQ ID NO: 650 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuacugccaucgacuuacauugg

SEQ ID NO: 651 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagauaguggugaaggacaauggc

SEQ ID NO: 652 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguccucauguacuggucccucaut

SEQ ID NO: 653 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaauuagcuguaucgucaaggc

SEQ ID NO: 654 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgaugcugagaaccaauaccagac

SEQ ID NO: 655 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucugcuggaucaugugagacaac

SEQ ID NO: 656 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaucuggauacaugcccaugaacc

SEQ ID NO: 657 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucagaaucuuguuggcugcauug

SEQ ID NO: 658 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagaaugugaaaauuccaguggc

SEQ ID NO: 659 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaguguauccuggagguuguug

SEQ ID NO: 660 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaccauguggacauuaggugug

SEQ ID NO: 661 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugaagaagaccuuugacucugt

SEQ ID NO: 662 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaggaggaggaugagauucuucca

SEQ ID NO: 663 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccuagaagacuccaagggagua

SEQ ID NO: 664 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggacgacauauaccugugugcua

SEQ ID NO: 665 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaugcuacgaagugggaaugauga

SEQ ID NO: 666 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaggcuaccauuauggagucugg

SEQ ID NO: 667 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuuacaauggcaggaccauucug

SEQ ID NO: 668 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuggaaguggucauuucagaugug

SEQ ID NO: 669 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagagaugcgccaauuguaaacaa

SEQ ID NO: 670 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaauuucuccuucagacaaugcagt

SEQ ID NO: 671 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucuuccagcuuaagaaugaacc

SEQ ID NO: 672 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauacagaagcugaugggccagaua

SEQ ID NO: 673 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucagaauuaccaagcuacggaagc

SEQ ID NO: 674 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucguuaaagucucucuucacccug

SEQ ID NO: 675 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccccaucuaugaguucaagauca

SEQ ID NO: 676 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgaguggcggaaagcaauaaaat

SEQ ID NO: 677 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacaaaggguggaugaaauugat

SEQ ID NO: 678 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccagugaugaucucaaugggcaat

SEQ ID NO: 679 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgagguguuuuuaccaccaagact

SEQ ID NO: 680 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguaaaugacuguguccagcaagut

SEQ ID NO: 681 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagcugccuacauaaaggaaugg

SEQ ID NO: 682 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuugcaagaugaaaggagaaggg

SEQ ID NO: 683 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacacuggaaaggaagagauucaug

SEQ ID NO: 684 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacuggaggagauggucaagaauc

SEQ ID NO: 685 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuguacacauguacaaugcccaat

SEQ ID NO: 686 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcacuuuuuggauacuuugugcct

SEQ ID NO: 687 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgcaauuuauguuuuccaagccac

SEQ ID NO: 688 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucccuggauauucuuaguagcg

SEQ ID NO: 689 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagagcucgaauuccagaaugauga

SEQ ID NO: 690 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuucagcgaggaagcuacacuuut

SEQ ID NO: 691 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaucaaguccuuugacagugcat

SEQ ID NO: 692 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucagaagugguuuccuuucucacc

SEQ ID NO: 693 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaguuucggacaguacaaagaacg

SEQ ID NO: 694 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaguccaaguugcuucucaguct

SEQ ID NO: 695 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcuuggagcaagaaaaggaauugc

SEQ ID NO: 696 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccaauccagaaaaccuuccaucg

SEQ ID NO: 697 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagugugccagauaccauugauga

SEQ ID NO: 698 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaucauuauucuggcuggagcaa

SEQ ID NO: 699 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauguaggcuuuuguuucguuugug

SEQ ID NO: 700 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuggcaacaaacaagauacuggug

SEQ ID NO: 701 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucguggcuuuugacaauaucucca

SEQ ID NO: 702 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaauaacuccucgguucuagggc

SEQ ID NO: 703 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucugaguaugagcuucccgaag

SEQ ID NO: 704 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacguccaucuuuuuaagggauugc

SEQ ID NO: 705 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucauuacgucaacgcaacgucua

SEQ ID NO: 706 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccacacauaaacggcaguguuaa

SEQ ID NO: 707 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagaaaagccuguuuaccaaggag

SEQ ID NO: 708 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagaucuucaccuauggaaagca

SEQ ID NO: 709 - DNA, 57 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguguugugggagauuuucaccua

SEQ ID NO: 710 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacugacuuuuacuccaggcuaacut

SEQ ID NO: 711 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguccuggucauuuauagaaaccga

SEQ ID NO: 712 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguucgugggcuuguuuuguaucaa

SEQ ID NO: 713 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguugaauguaaggcuuacaacgat

SEQ ID NO: 714 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugguucuggauuagcuggauuguc

SEQ ID NO: 715 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugugccuccuucaggaauucaauc

SEQ ID NO: 716 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaccaaguucuuucuuuugcacagg

SEQ ID NO: 717 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugugggcuacaagaacuaccgaua

SEQ ID NO: 718 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccucaccauagcuaaucuuggga

SEQ ID NO: 719 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccagcacuucugcauuggaacuaut

SEQ ID NO: 720 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugcauuguguguuuuugaccacug

SEQ ID NO: 721 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccucauuccuuuuuccucugugua

SEQ ID NO: 722 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccagccaaguagaaugugaaagac

SEQ ID NO: 723 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuuuuccuccuacucaccauccug

SEQ ID NO: 724 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucaaauuguugccauuucagggt

SEQ ID NO: 725 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagccuguuuugugucuacuguuct

SEQ ID NO: 726 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaccagagcuucaagacuguuuag

SEQ ID NO: 727 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuccuccucuucccuagauaact

SEQ ID NO: 728 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaucauucuugaggaggaaguagcg

SEQ ID NO: 729 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacucuaccuccagcacagaauuug

SEQ ID NO: 730 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuagacaacuaccuuucuacgga

SEQ ID NO: 731 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuuguugguguccauuuucuugt

SEQ ID NO: 732 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuccucuucagaggagaaagaaac

SEQ ID NO: 733 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacuaagaaugggaaggagucacc

SEQ ID NO: 734 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuguuccucccaguuuaagauut

SEQ ID NO: 735 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccaacacaagagaaaauauuugct

SEQ ID NO: 736 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaucucauuaaugacaaucagcca

SEQ ID NO: 737 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagcagaggcaucuguaaagucaug

SEQ ID NO: 738 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcaguugaaaaacuccuagaagcc

SEQ ID NO: 739 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcaguacacuaccaacagaucaa

SEQ ID NO: 740 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuaccagcuuugacaauacagga

SEQ ID NO: 741 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccucugagaaguaugucugaucca

SEQ ID NO: 742 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaaaguaccaaucagaaggacgug

SEQ ID NO: 743 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucagagccagaauuuugcagaaga

SEQ ID NO: 744 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaaccagaugcaguaugaguacac

SEQ ID NO: 745 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccaagucuuaugguucuggaucaa

SEQ ID NO: 746 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagugaaacugugugagaagaugg

SEQ ID NO: 747 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugucuaacucgggagacuaugaaa

SEQ ID NO: 748 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaaagaaacucuuucaucugcugc

SEQ ID NO: 749 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucuggcguugguguuuucaaaaua

SEQ ID NO: 750 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugaauaacaacuugagugacgag

SEQ ID NO: 751 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaagaugcugaaauccagaagcuga

SEQ ID NO: 752 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacuagcugccaaguacuuggauaa

SEQ ID NO: 753 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauaaugcuguuuccuuuaccuggga

SEQ ID NO: 754 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggucaaagaauauggccagaagag

SEQ ID NO: 755 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguaaaccaacagcucacaaaggaga

SEQ ID NO: 756 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugaagagcaucaacaagaagacca

SEQ ID NO: 757 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuugaaauccgccugaaugaacaag

SEQ ID NO: 758 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuuaagguugaagugugguucagg

SEQ ID NO: 759 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuuucuuucucagaaagcagaggct

SEQ ID NO: 760 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguaucaacaucacggacaucucaa

SEQ ID NO: 761 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucuaaagaucaaaacaccccugt

SEQ ID NO: 762 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuagaacgaguaaaucugucugcagc

SEQ ID NO: 763 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucaucgugauucaggagacaauuct

SEQ ID NO: 764 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcuguuucugguguuaucagugac

SEQ ID NO: 765 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacauggcacuagaagaacgcuuag

SEQ ID NO: 766 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaaagacaaaugugaaauuguggg

SEQ ID NO: 767 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacacauucauucauaacacuggga

SEQ ID NO: 768 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuaaucagcaagcuuucucugcug

SEQ ID NO: 769 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagaugcaagcaguuauugaugcaa

SEQ ID NO: 770 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauagcaagaaggaagugccuaucca

SEQ ID NO: 771 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucccacagcuaauuuggaccaaaag

SEQ ID NO: 772 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuucuucgucuuaucuuugggacc

SEQ ID NO: 773 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaggaagccagaguuuauuaacugc

SEQ ID NO: 774 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaugagaagaagcaccaugacaat

SEQ ID NO: 775 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaggguaaaguucacaaaagacca

SEQ ID NO: 776 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccaaaaaugugcauacucacagag

SEQ ID NO: 777 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguaucaucuccugaagcaacauct

SEQ ID NO: 778 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuggauaaugaaagacuccuuccc

SEQ ID NO: 779 - DNA, 58 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucagauagcauacaagagaccaugc

SEQ ID NO: 780 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaagaccaagaagaacuuacuccct

SEQ ID NO: 781 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugugaucuauuuuucccuuucucccca

SEQ ID NO: 782 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcaagaggcuuuggaguauuucaug

SEQ ID NO: 783 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacaaaugcugaaagcuguaccauacc

SEQ ID NO: 784 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuaggugaauacuguucgagaggut

SEQ ID NO: 785 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuccaugccuuugagaaccuagaaat

SEQ ID NO: 786 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuucaaaaggaaguaucuuggccucca

SEQ ID NO: 787 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaacgcugugccaauuuuguaaaugt

SEQ ID NO: 788 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaucauguugcagcaauucacugua

SEQ ID NO: 789 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacuuuacccuguaauaauccgugct

SEQ ID NO: 790 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagugaugagagugacauguacugut

SEQ ID NO: 791 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagucccaaccaugucaaaauuacag

SEQ ID NO: 792 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauugccaacaugacuuacuugauccc

SEQ ID NO: 793 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuacccucuucagcucaguuucuuuc

SEQ ID NO: 794 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugagauccauugaccucaauuuug

SEQ ID NO: 795 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguggaccccaagcuuuaguaaauat

SEQ ID NO: 796 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaauacccccuccaucaacuucuuca

SEQ ID NO: 797 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccaaagaucaaagagacgaaguct

SEQ ID NO: 798 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuagagaacuacccuggaaugaccc

SEQ ID NO: 799 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuugcuuaccugaggaacuuauuca

SEQ ID NO: 800 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccacauuacauacuuaccaugccact

SEQ ID NO: 801 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggaagcuguccaucaguauacauuc

SEQ ID NO: 802 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugucuauauccaucuccauguccuct

SEQ ID NO: 803 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauuauuguggccuguuugacucugt

SEQ ID NO: 804 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugacucuuuacuucaaacucugagcc

SEQ ID NO: 805 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucgucuucggaaauguuaugaagca

SEQ ID NO: 806 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugagagaguacugaauucuugcagcag

SEQ ID NO: 807 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuucaaaaucaaguuugcugagact

SEQ ID NO: 808 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcaauucacuaacaagaaaacaggga

SEQ ID NO: 809 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaauacacagacaaacuccagaaagc

SEQ ID NO: 810 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuacuguuugcuccuaacuugcucut

SEQ ID NO: 811 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagagaggaaagucccuuauugauug

SEQ ID NO: 812 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugagugugguggaguucaguuucuat

SEQ ID NO: 813 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagaccuugcagaaauaggaauugct

SEQ ID NO: 814 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagaaaaugaaaaggaguuagcagc

SEQ ID NO: 815 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaguaacacaucuucucaaccaggac

SEQ ID NO: 816 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggauuuuucuuaccacaacaugaca

SEQ ID NO: 817 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuucaguuugcugaagucaaggagg

SEQ ID NO: 818 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggauuucuucugaugguagcuuuugt

SEQ ID NO: 819 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagucuacaaaaagaccugcuagagc

SEQ ID NO: 820 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguguggaugaaacuuugauguguuca

SEQ ID NO: 821 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaauuauggaccagacucagugcct

SEQ ID NO: 822 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucgggaggaauucaucauauucaacag

SEQ ID NO: 823 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaaaagacauggaugaaagacgacga

SEQ ID NO: 824 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguaggacuguagacagugaaacuug

SEQ ID NO: 825 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuauugggauauccuuucacucugca

SEQ ID NO: 826 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugaucgggaaacacaaaaacaucat

SEQ ID NO: 827 - DNA, 59 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuccuagcugaaugcuauaaccucug

SEQ ID NO: 828 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuccugguuauaggaaauuacacuggc

SEQ ID NO: 829 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccaagcaauucuaugcuauacacac

SEQ ID NO: 830 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacaaagauuugugauuuuggucuagc

SEQ ID NO: 831 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaccaacuuuucccaguuucucaat

SEQ ID NO: 832 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccuuuccucuggaguaucuacaugaa

SEQ ID NO: 833 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacagcaucaagcuauguacguaguuc

SEQ ID NO: 834 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagauuucuuguuacuuuuuccccagac

SEQ ID NO: 835 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacuguuguuucacaagaugauguuug

SEQ ID NO: 836 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuugacaguuaaaggcauuuccugug

SEQ ID NO: 837 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccuucggcuuuuucaacccuuuuuaa

SEQ ID NO: 838 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaaacaacauucaacucccuacuuug

SEQ ID NO: 839 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaaucaucaacaucaacauugcagact

SEQ ID NO: 840 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauggcugaucuugaagguuuacacut

SEQ ID NO: 841 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaguauuacaauagagcugggaugga

SEQ ID NO: 842 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaggauccuguaauuauugaaagagc

SEQ ID NO: 843 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuagaagacuugacuggucuuacauugc

SEQ ID NO: 844 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggaagaagcagaucagauacgaaaaa

SEQ ID NO: 845 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacaguaaagagauuguggcuaucagc

SEQ ID NO: 846 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucguauacaaaggaaacucagacuccag

SEQ ID NO: 847 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaugaaucauuuggagguggauuugct

SEQ ID NO: 848 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuccacuugucagugaaguucaaaua

SEQ ID NO: 849 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagacuuggaucgaauucucacucuc

SEQ ID NO: 850 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaagggaucuuccaguaugacuaccat

SEQ ID NO: 851 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguaacgaaacagacagucuuacagaag

SEQ ID NO: 852 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugaaacacucagaaaaacaguugagg

SEQ ID NO: 853 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuagaggaagaguuaagaaaggccaac

SEQ ID NO: 854 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcagaacaggauauaacuaccuuggag

SEQ ID NO: 855 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacagugagagacuucaguaugaaaaa

SEQ ID NO: 856 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaauuaugagaccuacugaugucccug

SEQ ID NO: 857 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuccucagggaauacuuugagaggut

SEQ ID NO: 858 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuugcaagcugauaaugauuucacca

SEQ ID NO: 859 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguugcuccagcacuaaguguauuuaat

SEQ ID NO: 860 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccucacuuucaauaucacgaagaccat

SEQ ID NO: 861 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagaaaccacuggauggagaauauut

SEQ ID NO: 862 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaucgguagccaagcuggaaaagaca

SEQ ID NO: 863 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugguuacuaguuuagaagaaucccuga

SEQ ID NO: 864 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaguuauccaaguucccaacacagauc

SEQ ID NO: 865 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguggaaaaagauuuagcaggcuagac

SEQ ID NO: 866 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagaaugaaucuggcacauggauucag

SEQ ID NO: 867 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugccgugauagaaaauauacagcgagaa

SEQ ID NO: 868 - DNA, 60 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuguggcucauaaagcauuucugaaaaa

SEQ ID NO: 869 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugccuaucauagucauucagugauugut

SEQ ID NO: 870 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaguagcuccaaauuaaugaaugugcat

SEQ ID NO: 871 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucaugucugaacugaagauaaugact

SEQ ID NO: 872 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuacccaaauugcuucugucuguuaaaug

SEQ ID NO: 873 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaaugguuuucuuuucuccuccaacct

SEQ ID NO: 874 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauagugauuaguaaaggagcccaagaat

SEQ ID NO: 875 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaauuaacuuacuugccacugaaaaguug

SEQ ID NO: 876 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccgugaagaucccauugucuaugaaaut

SEQ ID NO: 877 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuuccuagagaguuagaguaacuuca

SEQ ID NO: 878 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugucuuuauauucaugaccuacuggca

SEQ ID NO: 879 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucugaccccuucccaucaaaauuuuauct

SEQ ID NO: 880 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucccuuuggguuauaaauagugcacuc

SEQ ID NO: 881 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucuugacaaagcaaauaaagacaaagc

SEQ ID NO: 882 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuaagggaaaaugacaaagaacagcuca

SEQ ID NO: 883 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggaagaaaaguguuuugaaauguguut

SEQ ID NO: 884 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaaaucuuuucucaaugaugcuuggcuc

SEQ ID NO: 885 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaggaacugugugcaaaaucuucaauug

SEQ ID NO: 886 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaagaauaaaaugucuagcagcaagaag

SEQ ID NO: 887 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaucagaucuggacuauauuagguccc

SEQ ID NO: 888 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggaacagauauccagaacuagugaacut

SEQ ID NO: 889 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggugaagaacuuaaaacugugacagaga

SEQ ID NO: 890 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccugaaaaccaaauacgaugaagaaact

SEQ ID NO: 891 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauguugacaacuaugaugacaucagaac

SEQ ID NO: 892 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaugaagacuuccuagagaauucacauc

SEQ ID NO: 893 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauaaaggacaagguaagaagaagacaag

SEQ ID NO: 894 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaacuggagaagaugaugacuauguuga

SEQ ID NO: 895 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccugugaagaaaauguguguugauuut

SEQ ID NO: 896 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucaacaaacaggacuaaggaaaggaaa

SEQ ID NO: 897 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuacucagcugaaaagcagaguuaaaa

SEQ ID NO: 898 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagguucucacccauauauugauuuucgt

SEQ ID NO: 899 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagaaaaugaagaguuuguugaaguggg

SEQ ID NO: 900 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccaguuccuagcagauuuaauagacgag

SEQ ID NO: 901 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugggaauuggcuauucuuuacaacuguac

SEQ ID NO: 902 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggauuucaaaguguuaccucaagaagca

SEQ ID NO: 903 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacagaauugaaucagggagauaugaa

SEQ ID NO: 904 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucauauagugaucagagauuaaggccaag

SEQ ID NO: 905 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacauaaaauucacaggaaaucagaucca

SEQ ID NO: 906 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucuuuucaggagguguaaaacaagaaaaa

SEQ ID NO: 907 - DNA, 61 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugaaaaauggcaaagaauucaaaccug

SEQ ID NO: 908 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuguucaauuuuguugagcuucugaaut

SEQ ID NO: 909 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaucgggaagcauaagaauaucaucaac

SEQ ID NO: 910 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuauuuauuggucucucauucucccaucc

SEQ ID NO: 911 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccaaguacauauccuguaagaccagaat

SEQ ID NO: 912 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagccuaaucuuucauuauuacugggaa

SEQ ID NO: 913 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacggguuauuaacauauuucagagcaac

SEQ ID NO: 914 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaagcagggauuucauucaucauuaaga

SEQ ID NO: 915 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuguaaauacgaaucuuuccaaaggaga

SEQ ID NO: 916 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuugaaagcguuugagaaucuuuuaggaca

SEQ ID NO: 917 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaguugaagauuuaccacugaaacugaca

SEQ ID NO: 918 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuuuuggaaacauacaggauaucuacc

SEQ ID NO: 919 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaccaauacuucagaagacaaaugugaaaa

SEQ ID NO: 920 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauugaagaagcauacaugacaaaaugug

SEQ ID NO: 921 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauuuggauuuuccugccuuaagaaaaa

SEQ ID NO: 922 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguacaaacauuucaagaagacaaaagat

SEQ ID NO: 923 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugugauaauuugcaacauaguaagaaggg

SEQ ID NO: 924 - DNA, 62 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagucagaauauuccuguuccuacuaca

SEQ ID NO: 925 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugucucaaaguaaacuauuguuagcaaccat

SEQ ID NO: 926 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaaugcaaauuaguuucuugcaagagaaaa

SEQ ID NO: 927 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugauaaacuucagaaagaacucaauguact

SEQ ID NO: 928 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacuggagagauaugucaagucuuguuuac

SEQ ID NO: 929 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaugacaaaaagcuucagaguucucuaaaa

SEQ ID NO: 930 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaugagaaagaagaagaauuccucacuaaug

SEQ ID NO: 931 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaaaagaacaagagaugaauugauagagt

SEQ ID NO: 932 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaugcaaauuucacagagccucaguuuuat

SEQ ID NO: 933 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaauaccaaaaguuaccaaaacugcagaca

SEQ ID NO: 934 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaagaagaccuuucuguggaaauagaugac

SEQ ID NO: 935 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuuggaaauuauggaaaucaagcaacuucaa

SEQ ID NO: 936 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauggaaaaggagcacuuaaauaagguucag

SEQ ID NO: 937 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuccuuucuugaaaauaaucuugaacagcuc

SEQ ID NO: 938 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcuuaaaguugauaaagagaagugguua

SEQ ID NO: 939 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaccggcaaauuaaagcaauuaugaaagaa

SEQ ID NO: 940 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagcuacaucaauccuugaguauccuauug

SEQ ID NO: 941 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggacugcacuuuuauucaucaauucauaga

SEQ ID NO: 942 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucacaagauaaagugauuucaggaauagcaa

SEQ ID NO: 943 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaaaggaaaaucugcaaagaacuuuccug

SEQ ID NO: 944 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaaggaauuagagaaugcaaaugaccuuc

SEQ ID NO: 945 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaaaaugcagucagauauggagaaaaucca

SEQ ID NO: 946 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuacuacgaaauucuuaauuccccugacc

SEQ ID NO: 947 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugguuccuaauauguauugggauguugguaa

SEQ ID NO: 948 - DNA, 63 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguucucuucgucaugaucaacaaauauggt

SEQ ID NO: 949 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacagaaaugguuucaaaugaaucuguagact

SEQ ID NO: 950 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauugaucauauucacuaagcgcuacuagaaaca

SEQ ID NO: 951 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaacauguucaugcuguguauguaauagaaug

SEQ ID NO: 952 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaucaucucuaagguaucuucuagauccaaca

SEQ ID NO: 953 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaaagcuuuaaaugcacuaaauaaccugagt

SEQ ID NO: 954 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaauaugaucaacuccugaaagaacacucug

SEQ ID NO: 955 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaguuuacuccaguaaaaauugaagguuaug

SEQ ID NO: 956 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaauauuugcgauuauugaagcugcuuaaugt

SEQ ID NO: 957 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacacaguuaauaugccagaaaaagaaagaaa

SEQ ID NO: 958 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaucugugcucaauaaucaguuguuagaaat

SEQ ID NO: 959 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuggauuuguuucucauucucauauuucacca

SEQ ID NO: 960 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaaauaauucugugggaucaugaucugaauc

SEQ ID NO: 961 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauccggguauaauaaugaaguuaaaagagca

SEQ ID NO: 962 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcucauauucuacuucauucagaagaucagg

SEQ ID NO: 963 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucccgauuuaauucacauuuauaaaggcuuug

SEQ ID NO: 964 - DNA, 64 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguaacuaaauuggagaaaagcauugaugact

SEQ ID NO: 965 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauguuuucgaauuucucgaacuaauguauagaag

SEQ ID NO: 966 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaaaaacaaaguggacaacuagaaagauuuuga

SEQ ID NO: 967 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuuccuaagugcaaaagauaacuuuauauca

SEQ ID NO: 968 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugacauaacaguuaugauuuugcagaaaacaga

SEQ ID NO: 969 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuucagaaauuucuucaaauaaacagaacc

SEQ ID NO: 970 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagaagaaugacaaagauaagaagauagcugag

SEQ ID NO: 971 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugauguagauuuuaaucugaacuuugaaccauc

SEQ ID NO: 972 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggaggaacucuuuacuaugaaguuaauagaa

SEQ ID NO: 973 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauggagaagacaucaaccaauuaaucauaaauac

SEQ ID NO: 974 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauauuauuuucaugcuuuggagauuggauauagg

SEQ ID NO: 975 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaauccuuaucaaucaucaaugaaaaaguacc

SEQ ID NO: 976 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaugauuuacuuggagaagauuugcuaucugg

SEQ ID NO: 977 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaggaagaaaaucaucaauuacgaagugaaaa

SEQ ID NO: 978 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaggaagaaaucaagauucuuacugauaaacuc

SEQ ID NO: 979 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuagaaccaaugagagacuaucucaagaacuug

SEQ ID NO: 980 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauuaugaugagacagauccauuuauugauaacuc

SEQ ID NO: 981 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaagaacuuaaacgaaaauugaacauucugact

SEQ ID NO: 982 - DNA, 65 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauagcaagcugguauuuucauacaaauucuucua

SEQ ID NO: 983 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucuagcuacacugaaaaauuauaaugaaguagg

SEQ ID NO: 984 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaguaaacugacucuaaacuuaaaaucuuacct

SEQ ID NO: 985 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucagauauuuauccaaacauuauugcuaugggat

SEQ ID NO: 986 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauacuaaauaguuuaagaugagucauauuuguggg

SEQ ID NO: 987 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauucucaucucuaaaggauuuaauuacaaagaugc

SEQ ID NO: 988 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucuauguagucucugaaaauggaagaaaauat

SEQ ID NO: 989 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaacaagauagaagauuuggagcaagaaauaaa

SEQ ID NO: 990 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucaugcaacuuacugaaaaauacuauaaaugacc

SEQ ID NO: 991 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuuauuaaagaacuuucuaaaguaauucgagc

SEQ ID NO: 992 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaucucaggacucauuauuuuaacauuugggagaaa

SEQ ID NO: 993 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugcccuauauuugcauuaaaauggaauaagaaag

SEQ ID NO: 994 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgaugaauuaaaugcccacauaaaacuuucuaauuug

SEQ ID NO: 995 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauaguugcuauauuuacacugaugguagaaauaaa

SEQ ID NO: 996 - DNA, 66 bp, Artificial
  synthetic primer sequence
  misc_feature (21)..(23): n is a, c, g, t or u
  misc_feature (27)..(29): n is a, c, g, t or u
tctgtacggtgacaaggcgunnnactnnntgauccuauauuacagauucuauucaugaacaaugct

SEQ ID NO: 997 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccgcuguggcccucgug

SEQ ID NO: 998 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugacagcggcugcgauca

SEQ ID NO: 999 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggucgcccuccacgcag

SEQ ID NO: 1000 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaagugcccagcgagcua

SEQ ID NO: 1001 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaugccgauggccucc

SEQ ID NO: 1002 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagacgacagggcuggut

SEQ ID NO: 1003 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuggcaugacccccac

SEQ ID NO: 1004 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggcucucgcggaggaag

SEQ ID NO: 1005 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuguuggcgggcaacc

SEQ ID NO: 1006 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaguccggcuuggagg

SEQ ID NO: 1007 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaguccugccgagcact

SEQ ID NO: 1008 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacugguugguggcugga

SEQ ID NO: 1009 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagcugcauggugcggut

SEQ ID NO: 1010 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaggcuccagugcuggut

SEQ ID NO: 1011 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaggcuccuccaggcuca

SEQ ID NO: 1012 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauccucugccccaccct

SEQ ID NO: 1013 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaacauggccuggcagc

SEQ ID NO: 1014 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaaaagggauucaauugccaucca

SEQ ID NO: 1015 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucuccaccgccgugt

SEQ ID NO: 1016 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccauccucuggagcca

SEQ ID NO: 1017 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccccaccugagacucc

SEQ ID NO: 1018 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcuuggccuggaggg

SEQ ID NO: 1019 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagcugagcgccuggca

SEQ ID NO: 1020 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaugucccggcgcuuga

SEQ ID NO: 1021 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcacacgcggaugugca

SEQ ID NO: 1022 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcgugaccgggacuucc

SEQ ID NO: 1023 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggcagcaggguggugag

SEQ ID NO: 1024 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggccaccuggaccuucc

SEQ ID NO: 1025 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggccagacugacccucc

SEQ ID NO: 1026 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggcccgugucuuggagg

SEQ ID NO: 1027 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggguaggccgugucugg

SEQ ID NO: 1028 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucagccagggcaccug

SEQ ID NO: 1029 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucagccccagggaugg

SEQ ID NO: 1030 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguguccuccgcugaggc

SEQ ID NO: 1031 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucagggcucugcagcuc

SEQ ID NO: 1032 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccacgcugcucggcat

SEQ ID NO: 1033 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccggcauucguguugc

SEQ ID NO: 1034 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucucugggagggcacug

SEQ ID NO: 1035 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugauggucgaggugcgg

SEQ ID NO: 1036 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugcacgucgguuuuggg

SEQ ID NO: 1037 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggccgcuccaacucac

SEQ ID NO: 1038 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguugcacugugccugg

SEQ ID NO: 1039 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuuuccgcggcaccuc

SEQ ID NO: 1040 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuccuuccuugccaacgc

SEQ ID NO: 1041 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugagcccaccugacuugg

SEQ ID NO: 1042 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcugccgaagaccaacug

SEQ ID NO: 1043 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagcccaggccuuucuug

SEQ ID NO: 1044 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaggaacucccgcagguut

SEQ ID NO: 1045 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuccaccccugaagccug

SEQ ID NO: 1046 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccgucuccuccacggaug

SEQ ID NO: 1047 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugaggcagaugcccagc

SEQ ID NO: 1048 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaggugguggugguccc

SEQ ID NO: 1049 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuaguugcauggguggcg

SEQ ID NO: 1050 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccagaucauccgcgagct

SEQ ID NO: 1051 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugagccugcaaucccug

SEQ ID NO: 1052 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuacccuuggccgcguac

SEQ ID NO: 1053 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucacaggucgugugugc

SEQ ID NO: 1054 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguaccggaggaagcggut

SEQ ID NO: 1055 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaccugcagcaugagcac

SEQ ID NO: 1056 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaugucuccgcuggucg

SEQ ID NO: 1057 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucagcgagaguggcagg

SEQ ID NO: 1058 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaugccaggugcaagcaca

SEQ ID NO: 1059 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacgacuguuggaccgug

SEQ ID NO: 1060 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagcgaaugggcagcaug

SEQ ID NO: 1061 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaggaguccgagguggug

SEQ ID NO: 1062 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccaguagcgcugcuucct

SEQ ID NO: 1063 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccguggagcuccucacac

SEQ ID NO: 1064 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgggaagcgggagaucut

SEQ ID NO: 1065 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucuugcggguacccacg

SEQ ID NO: 1066 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcuuccucaaggccga

SEQ ID NO: 1067 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuguagggacacagggca

SEQ ID NO: 1068 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccaugcgggucucucug

SEQ ID NO: 1069 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccuccggaaggucauct

SEQ ID NO: 1070 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccuuuuguccggcucct

SEQ ID NO: 1071 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcucgugucccccaacaa

SEQ ID NO: 1072 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggcgaucuccucguuugc

SEQ ID NO: 1073 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugggcuugucuugaggcug

SEQ ID NO: 1074 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugagggcugacgcagag

SEQ ID NO: 1075 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugggcucaggaaccgag

SEQ ID NO: 1076 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuacccgaggucccuggag

SEQ ID NO: 1077 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucagcgcgaucagcauct

SEQ ID NO: 1078 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccgcaggcuuccuuagg

SEQ ID NO: 1079 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucugcagaggacuccagc

SEQ ID NO: 1080 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugggucucugugagggca

SEQ ID NO: 1081 - DNA, 51 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucuucccgccuuucccg

SEQ ID NO: 1082 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucucccagagcaggacc

SEQ ID NO: 1083 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcacacaccaguugagc

SEQ ID NO: 1084 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacauagucccggaagcugc

SEQ ID NO: 1085 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugguacgccuccagaugagc

SEQ ID NO: 1086 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguacacgucccgggacat

SEQ ID NO: 1087 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugagguuggaguccauggg

SEQ ID NO: 1088 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaccuggcuccucuucac

SEQ ID NO: 1089 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauuccuaccggaagcaggt

SEQ ID NO: 1090 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgugugaugcagcucuucg

SEQ ID NO: 1091 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugugcccacgaaggagt

SEQ ID NO: 1092 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuagucccuggcuggacca

SEQ ID NO: 1093 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucuugaccagcacguucc

SEQ ID NO: 1094 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgguuuucccggacauggt

SEQ ID NO: 1095 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcugugugcuggcagat

SEQ ID NO: 1096 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaugcaccacggccacaua

SEQ ID NO: 1097 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucagaacugccgaccaca

SEQ ID NO: 1098 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccucuugaccuguccaggc

SEQ ID NO: 1099 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccaugcuggaccuucugca

SEQ ID NO: 1100 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggacgacccagagcugaug

SEQ ID NO: 1101 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugcaguggaacuccacg

SEQ ID NO: 1102 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccauggcaaacaccauga

SEQ ID NO: 1103 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuccugaacccugaaggc

SEQ ID NO: 1104 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuccccuucucugcccaga

SEQ ID NO: 1105 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguugcccuuggaggcauac

SEQ ID NO: 1106 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauugcaggcucaccccaat

SEQ ID NO: 1107 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaugcaccaguggugguct

SEQ ID NO: 1108 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaaucugucugcugcuccugt

SEQ ID NO: 1109 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaugcugcagaugcugct

SEQ ID NO: 1110 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagcaaccacucgauccugt

SEQ ID NO: 1111 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagcuccaucugcauggcut

SEQ ID NO: 1112 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagcugaggccuugcagaac

SEQ ID NO: 1113 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaagcagcccucucccag

SEQ ID NO: 1114 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaccagacacagcaucugc

SEQ ID NO: 1115 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacuccagccgucucuugc

SEQ ID NO: 1116 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagugggcagguccuucaa

SEQ ID NO: 1117 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucggaaccugcacacag

SEQ ID NO: 1118 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuuguggcuuucaggguc

SEQ ID NO: 1119 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgaugucauucgcugcagt

SEQ ID NO: 1120 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgcuccaaaacacgaccut

SEQ ID NO: 1121 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcagggccaucuuggag

SEQ ID NO: 1122 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugccuugucccacaucag

SEQ ID NO: 1123 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuuccccauccauuucggg

SEQ ID NO: 1124 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaguugaacuggcggccat

SEQ ID NO: 1125 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaggagccaaggucagug

SEQ ID NO: 1126 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccacgagaguguggugag

SEQ ID NO: 1127 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccacuccgcaggauaaac

SEQ ID NO: 1128 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggauccuuguccccaccat

SEQ ID NO: 1129 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucaccccuuccuuggcac

SEQ ID NO: 1130 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucgggauggagaaagcga

SEQ ID NO: 1131 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccggcugcaaugaucagg

SEQ ID NO: 1132 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccucagcucccgguucuc

SEQ ID NO: 1133 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugcuuggagucagcugagg

SEQ ID NO: 1134 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugggaucuccuugggugcc

SEQ ID NO: 1135 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguguccacaccugugucc

SEQ ID NO: 1136 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuugagcgugugaagacugc

SEQ ID NO: 1137 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuugcgcuucuccuccucct

SEQ ID NO: 1138 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccacauccaccgaggcaut

SEQ ID NO: 1139 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaguccuugcgugcauuguc

SEQ ID NO: 1140 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagcgaaugggcagcauug

SEQ ID NO: 1141 - DNA, 52 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugacucggcccugagugaua

SEQ ID NO: 1142 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucggcuuuaccuccaauggug

SEQ ID NO: 1143 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaggaugagccugaccagug

SEQ ID NO: 1144 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaacaguagcuucccugggt

SEQ ID NO: 1145 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguagcugacccugccuacct

SEQ ID NO: 1146 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuuaccaggcaaggccuugg

SEQ ID NO: 1147 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucauuucugcuggcgcaca

SEQ ID NO: 1148 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucguagaccuggguccct

SEQ ID NO: 1149 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaguccacagucuggaagcg

SEQ ID NO: 1150 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucggcccaacaccuucaucat

SEQ ID NO: 1151 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguagagugugcguggcucuc

SEQ ID NO: 1152 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuggcucugacuguaccacc

SEQ ID NO: 1153 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggccaucuacaagcaguca

SEQ ID NO: 1154 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgcaucguguacuuccggat

SEQ ID NO: 1155 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccuuccuguccuccuagca

SEQ ID NO: 1156 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaaggcgggagacauaugg

SEQ ID NO: 1157 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaagccgaaggucacaaaguc

SEQ ID NO: 1158 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagguccucaagucuucggg

SEQ ID NO: 1159 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagcuggccuuaccauccug

SEQ ID NO: 1160 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaccuggccuucauacacc

SEQ ID NO: 1161 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucuuucucuuccgcaccca

SEQ ID NO: 1162 - DNA, 53 bp, Artificial; identical to SEQ ID NO: 1160
  synthetic primer sequence
  misc_feature (21)..(23): n is a, c, g, t or u
  misc_feature (27)..(29): n is a, c, g, t or u

SEQ ID NO: 1163 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccaggaaggacuccacuuc

SEQ ID NO: 1164 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccaugccauaguccaugcc

SEQ ID NO: 1165 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacggagaccacucuucacga

SEQ ID NO: 1166 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaugauuugcaaagcgcacac

SEQ ID NO: 1167 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaugucugugugucccgucaa

SEQ ID NO: 1168 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauguugcacagccuccuugg

SEQ ID NO: 1169 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaucgcgguagaggcuguc

SEQ ID NO: 1170 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagguggagaaguuccuggt

SEQ ID NO: 1171 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccgugccuguauucaagug

SEQ ID NO: 1172 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccgagggaauucccacuuug

SEQ ID NO: 1173 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuggacagcuugugggaag

SEQ ID NO: 1174 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuugucccuccuucaaggg

SEQ ID NO: 1175 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgcccagagugaagaucucc

SEQ ID NO: 1176 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucguacggucagguugacg

SEQ ID NO: 1177 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugaccuagugugagggagg

SEQ ID NO: 1178 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuggacguugaugccacuga

SEQ ID NO: 1179 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuucuucuccaccgggucuc

SEQ ID NO: 1180 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcucagcuuguacucagggc

SEQ ID NO: 1181 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcuccuucaguugaggcugg

SEQ ID NO: 1182 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggguguuggaguucauggag

SEQ ID NO: 1183 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugacguugugcaaggaga

SEQ ID NO: 1184 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugcacuucacaacagggt

SEQ ID NO: 1185 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucauagugggcuucagccg

SEQ ID NO: 1186 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucuggacgcccgauucuuc

SEQ ID NO: 1187 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuauagguccgguggacaggg

SEQ ID NO: 1188 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucucagcugaggagaugggt

SEQ ID NO: 1189 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuugaaggcauccacggag

SEQ ID NO: 1190 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugcccaaagcaaccuucucc

SEQ ID NO: 1191 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugucuucaggcugauguugc

SEQ ID NO: 1192 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucucgcuucagcacgaugt

SEQ ID NO: 1193 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuguugagcacaaggagcag

SEQ ID NO: 1194 - DNA, 53 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuucagcaucuucacggcca

SEQ ID NO: 1195 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccauucuguucucucuggca

SEQ ID NO: 1196 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaauccugcugccacacauug

SEQ ID NO: 1197 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuuggagcuggagcucuugug

SEQ ID NO: 1198 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagcauccaacaaggcacuga

SEQ ID NO: 1199 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaugccugaccaguuagagg

SEQ ID NO: 1200 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaugaggaaguagccuccca

SEQ ID NO: 1201 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugggcacuugcacagagat

SEQ ID NO: 1202 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucguugaacucugacagcaggt

SEQ ID NO: 1203 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauucggacacacuggcuguac

SEQ ID NO: 1204 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccuucucugucucccuugga

SEQ ID NO: 1205 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucccgugagcacaaucucaa

SEQ ID NO: 1206 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaccuucauuggcuacaagg

SEQ ID NO: 1207 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuuuucccucaggcccucat

SEQ ID NO: 1208 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuccuacaguacuccccugcc

SEQ ID NO: 1209 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacuucucacaccgcugugut

SEQ ID NO: 1210 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccaucacacaccauaacucc

SEQ ID NO: 1211 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaacccuccugauguacacggt

SEQ ID NO: 1212 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugccuuucuccccaaccag

SEQ ID NO: 1213 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccuucagcacucugcuugug

SEQ ID NO: 1214 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucuaucggcaaagcggugut

SEQ ID NO: 1215 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacauugggagcugaugaggat

SEQ ID NO: 1216 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuuccuacaggaagccuccc

SEQ ID NO: 1217 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagguggcaccaaagctgtaut

SEQ ID NO: 1218 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagucuuccccacuucugccut

SEQ ID NO: 1219 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaugcuuucaggaggcauccag

SEQ ID NO: 1220 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauuccgaugucagcaccaaag

SEQ ID NO: 1221 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacagugauaggagguguggg

SEQ ID NO: 1222 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaccguuccaccugaaagact

SEQ ID NO: 1223 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccccugcucuucaauacagcc

SEQ ID NO: 1224 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccucagcuaccaggauguut

SEQ ID NO: 1225 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccucuucgaaccuguccauga

SEQ ID NO: 1226 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccugcucaguguagcuaggut

SEQ ID NO: 1227 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuacacuuggcugggcaaaga

SEQ ID NO: 1228 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuccauccugagucauggcut

SEQ ID NO: 1229 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucccucuggaaauccuuccg

SEQ ID NO: 1230 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucgcugagauugaacuggag

SEQ ID NO: 1231 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugaguccuccucaccacuga

SEQ ID NO: 1232 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuucgccuagcucccuuuuca

SEQ ID NO: 1233 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaagacaugagcucgagugct

SEQ ID NO: 1234 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaauauguggaagcccacagc

SEQ ID NO: 1235 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcagcaaguccaacugcuaug

SEQ ID NO: 1236 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaggcuggacguacauucut

SEQ ID NO: 1237 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcagugaugccuaccaacugt

SEQ ID NO: 1238 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaauacuccagcucacaggg

SEQ ID NO: 1239 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggagcuugcucagcuuguact

SEQ ID NO: 1240 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggguagcagacaaaccugugg

SEQ ID NO: 1241 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuuccaggagagagactccaga

SEQ ID NO: 1242 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugucuucauccucgauggt

SEQ ID NO: 1243 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugauccuugccagguaaucc

SEQ ID NO: 1244 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugguucguggcucucuuauc

SEQ ID NO: 1245 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucccaaauucugccaggaagc

SEQ ID NO: 1246 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccuucuccaaggccagaauc

SEQ ID NO: 1247 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuccacuagcaccaaggaca

SEQ ID NO: 1248 - DNA, 54 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggccaagcaaucugcguaut

SEQ ID NO: 1249 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaacgccuguuuucuuucugcc

SEQ ID NO: 1250 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuggccaagaguuacgggauuc

SEQ ID NO: 1251 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaggaguguguacucuugcaucg

SEQ ID NO: 1252 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugggacauucaccacaucgacua

SEQ ID NO: 1253 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucugaaucucugugcccucag

SEQ ID NO: 1254 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuuccugguuggccguuauat

SEQ ID NO: 1255 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugaacugcuagccucuggauut

SEQ ID NO: 1256 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugacuuggugucaugcaccuacc

SEQ ID NO: 1257 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaagggagucacucugguuugg

SEQ ID NO: 1258 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugaaauuggugucggugccua

SEQ ID NO: 1259 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagauacugaucucgccaucgct

SEQ ID NO: 1260 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugguuggagcgaaucugcuag

SEQ ID NO: 1261 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaacaugugugagcacagcaac

SEQ ID NO: 1262 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugccucuugcuucucuuuucct

SEQ ID NO: 1263 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguucuccaggucgaaaggguac

SEQ ID NO: 1264 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuggauccucaggacucuguct

SEQ ID NO: 1265 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucguugaagcacuggauccacut

SEQ ID NO: 1266 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccacauccucuuccucaggaut

SEQ ID NO: 1267 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaacgaccaagucaccaaggaug

SEQ ID NO: 1268 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagaguucauggaugcacugga

SEQ ID NO: 1269 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuacuccacagugagcucgaucc

SEQ ID NO: 1270 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaaggcuguuuuggagaugga

SEQ ID NO: 1271 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacagcauacaugcauuccucag

SEQ ID NO: 1272 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccaucggugucauccucauca

SEQ ID NO: 1273 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagacugucucggacuguaacuc

SEQ ID NO: 1274 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaacacugccgaggugauuut

SEQ ID NO: 1275 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucauugcugauaacggaggc

SEQ ID NO: 1276 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccagagcaaggaaguguuauc

SEQ ID NO: 1277 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccucccucaggacuguaacaga

SEQ ID NO: 1278 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgagcccccuaaagugaagauc

SEQ ID NO: 1279 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgcuuccuucagggucuucauc

SEQ ID NO: 1280 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuuucaauguugccaccacact

SEQ ID NO: 1281 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaccuuggcugcaugaaguuut

SEQ ID NO: 1282 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagcuucccucuggaucucuca

SEQ ID NO: 1283 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaucguuugugguuaguguca

SEQ ID NO: 1284 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccgtctucctccatctcauag

SEQ ID NO: 1285 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggcuaucuccagguagucuggg

SEQ ID NO: 1286 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugggugcuguauucugcaggauc

SEQ ID NO: 1287 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggguuguagucggucaugaugg

SEQ ID NO: 1288 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugguguucaaagaacuugga

SEQ ID NO: 1289 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccuccacagugagguuaggug

SEQ ID NO: 1290 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugaagaugacuuccuuucucgc

SEQ ID NO: 1291 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucaccagcgucaaguugaugg

SEQ ID NO: 1292 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuucuggcauugaucucggcut

SEQ ID NO: 1293 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucuucaucacguuguccucgg

SEQ ID NO: 1294 - DNA, 55 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacaagaacagugcagagggut

SEQ ID NO: 1295 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuguuucugggaaacucccauut

SEQ ID NO: 1296 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugcuggaagccuuugucuauga

SEQ ID NO: 1297 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuccagaccaggguguuguuuuc

SEQ ID NO: 1298 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacagcaaagcagaaacucacauc

SEQ ID NO: 1299 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuagagggacucuucccaaugga

SEQ ID NO: 1300 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugauaaagcacccuccaucgut

SEQ ID NO: 1301 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaugacggaauauaagcugguggt

SEQ ID NO: 1302 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccaagccugggaccucuauuat

SEQ ID NO: 1303 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucugcaugguacucugucucg

SEQ ID NO: 1304 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccucauuucuccuccauccucag

SEQ ID NO: 1305 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaccuuguccuaaccucucucc

SEQ ID NO: 1306 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugguuuacagagaaacccacca

SEQ ID NO: 1307 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaucagagaaagggacccuagt

SEQ ID NO: 1308 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguugccacuuucucaacuuuccc

SEQ ID NO: 1309 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuuuccucucacuggcuucucc

SEQ ID NO: 1310 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacugcuguuccuucauacacuuc

SEQ ID NO: 1311 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauaccccagcucagaucuucucc

SEQ ID NO: 1312 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcauguuuguuggugauuccaag

SEQ ID NO: 1313 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaauguguaaauugccgagcacg

SEQ ID NO: 1314 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaugcuuauucauggcaggacca

SEQ ID NO: 1315 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaugaugaucuccagguacagg

SEQ ID NO: 1316 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaggucuguccucaaggaauggat

SEQ ID NO: 1317 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucaccacgaaauccuugguct

SEQ ID NO: 1318 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucaggagucuguuggaccuug

SEQ ID NO: 1319 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccaaacugcuccagguaauccac

SEQ ID NO: 1320 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccauccuucauagcuguaugcac

SEQ ID NO: 1321 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccaagaaaucgaacuccacaag

SEQ ID NO: 1322 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccucuuugaggucuuguccaguc

SEQ ID NO: 1323 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucgauuccuggcuuuucaucucut

SEQ ID NO: 1324 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugacaccagaucagaaagguct

SEQ ID NO: 1325 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugaggauuuccagcaaauaggg

SEQ ID NO: 1326 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugaacuccugcaugucaucag

SEQ ID NO: 1327 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguaacaauaccagugaagacccg

SEQ ID NO: 1328 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguaguagugguuguggcacuugg

SEQ ID NO: 1329 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucacauucaggaugugcuuucg

SEQ ID NO: 1330 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuccucagaucauucuccagct

SEQ ID NO: 1331 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuacagcuucucccaguaagcauc

SEQ ID NO: 1332 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuauggaggccaaugcucucuuca

SEQ ID NO: 1333 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuacauuuguagguguggcugt

SEQ ID NO: 1334 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugacaggaagaccuugagguaga

SEQ ID NO: 1335 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugguugaggacugugagacagut

SEQ ID NO: 1336 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuauccuuaaggagcccugugug

SEQ ID NO: 1337 - DNA, 56 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucaacacagcuguugguuucuc

SEQ ID NO: 1338 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagacgucacuuucaaacguguat

SEQ ID NO: 1339 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucucuuggaaacucccaucuugag

SEQ ID NO: 1340 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagugacagaaagguaaagaggagc

SEQ ID NO: 1341 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggaguuugucugcugaaugaacc

SEQ ID NO: 1342 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguccuucucuuccagagacuucag

SEQ ID NO: 1343 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugugccagggaccuuaccuuaua

SEQ ID NO: 1344 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuugccaucauuguccaacaaaguc

SEQ ID NO: 1345 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuguuaaccuugcagaauggucga

SEQ ID NO: 1346 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuuucagcauuaacaugcgugct

SEQ ID NO: 1347 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggccaugaauucgucagcuaguut

SEQ ID NO: 1348 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugacuggauccacaaccaaaat

SEQ ID NO: 1349 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugcagccaugauccaauucuca

SEQ ID NO: 1350 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucccagaauuaccaagugagucc

SEQ ID NO: 1351 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaaagagaagugcaugugcaagac

SEQ ID NO: 1352 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugccuuuaaaaauuugccccgat

SEQ ID NO: 1353 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagugccacuggucuauaauccaga

SEQ ID NO: 1354 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaaggccugcugaaaaugacugaa

SEQ ID NO: 1355 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucauuguuccuuccccucagac

SEQ ID NO: 1356 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucugauccuaaaacccagccuct

SEQ ID NO: 1357 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuacagcccuggauuugucaagut

SEQ ID NO: 1358 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccguuguacacucaucuuccuag

SEQ ID NO: 1359 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugcaguugguggaaccauuaacuc

SEQ ID NO: 1360 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuucaccuuuaacaccuccagucc

SEQ ID NO: 1361 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaaacuaugauggugacgugcag

SEQ ID NO: 1362 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugaugauugggagauuccugaug

SEQ ID NO: 1363 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagacccaaagggcaguaagauagg

SEQ ID NO: 1364 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaauaagguucacaucaggaagggt

SEQ ID NO: 1365 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaauaugcucagaccagucaucugc

SEQ ID NO: 1366 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaucucccaaucaucacucgaguc

SEQ ID NO: 1367 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagcaucaaauuugcgcuggauuuc

SEQ ID NO: 1368 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucaucuccaucucagacaccag

SEQ ID NO: 1369 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucauuuugagaugcuugcaauugcc

SEQ ID NO: 1370 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccagguuuauuaaauuucgcagc

SEQ ID NO: 1371 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuccuucuccgcacauuuuacaag

SEQ ID NO: 1372 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucuuugucggugguauuaacucc

SEQ ID NO: 1373 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugguccaacuucauuuucugaga

SEQ ID NO: 1374 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaguccauuaugaugcuccaggug

SEQ ID NO: 1375 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccaauucacugugguuuaagugc

SEQ ID NO: 1376 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccagagucauagcuggaguaact

SEQ ID NO: 1377 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggacaucagugguacugagcaaua

SEQ ID NO: 1378 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggucuauuccuguugaagcagcaa

SEQ ID NO: 1379 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugguggcuaauagcuucuucuguuc

SEQ ID NO: 1380 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucacagcugcaguugaaaaagut

SEQ ID NO: 1381 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuuuccuuccuuuaucccaggug

SEQ ID NO: 1382 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuagcaggucaaaagugaacugaug

SEQ ID NO: 1383 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaucucuuccauaggcuccugcug

SEQ ID NO: 1384 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaugcuaucugagccgucuagact

SEQ ID NO: 1385 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucagucuccaugauagugguccag

SEQ ID NO: 1386 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggacuuccaugugcaaacacuac

SEQ ID NO: 1387 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugugcuguccauuuucacuuucug

SEQ ID NO: 1388 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuaccaaaaggcaaaaucccacca

SEQ ID NO: 1389 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucacuuccaauauucucugcugc

SEQ ID NO: 1390 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucuggauuucagcuuuggaaagt

SEQ ID NO: 1391 - DNA, 57 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuugcagaaggaacaccuauucgut

SEQ ID NO: 1392 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcacaccagaaaagucuuaguaacc

SEQ ID NO: 1393 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguuuccaaaugacaaccaggacaa

SEQ ID NO: 1394 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuuugugauccgaccaugaguaag

SEQ ID NO: 1395 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggugaaaccuguuuguuggacaua

SEQ ID NO: 1396 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcaaauguaaucuaccaggcuuugg

SEQ ID NO: 1397 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagccauaguggagagcuguaaaut

SEQ ID NO: 1398 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacauguaugccagcuguuagagaut

SEQ ID NO: 1399 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaccccagcaaagcauuuuaagauc

SEQ ID NO: 1400 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuacaucaugagaggaaugcaggaat

SEQ ID NO: 1401 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacuuaauuuggauuguggcacaga

SEQ ID NO: 1402 - DNA, 50 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucggugucagccuccact

SEQ ID NO: 1403 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuuugcgugguguagauaugauca

SEQ ID NO: 1404 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucuccuuccuccuguaguuucaga

SEQ ID NO: 1405 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucaggacuuagcaagaaguuaugg

SEQ ID NO: 1406 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaucacagaauuccuccaggcuuct

SEQ ID NO: 1407 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacgggaaaguggugaagauaugug

SEQ ID NO: 1408 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguggguccugaauuggaggaauat

SEQ ID NO: 1409 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaccuggaacuuggucucaaagaut

SEQ ID NO: 1410 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaccauaucaaauucacacacuggc

SEQ ID NO: 1411 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcuuuuccaucuuuucuguguuggt

SEQ ID NO: 1412 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccaguuguggguaccuuuagauuc

SEQ ID NO: 1413 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaagagaucauuugccccaucaaut

SEQ ID NO: 1414 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaagaucuaugucauaaaagcagggc

SEQ ID NO: 1415 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacggcgauauuuugucugauguagg

SEQ ID NO: 1416 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuaucugcagguuucaucugaaug

SEQ ID NO: 1417 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacugcaugcaauuucuuuuccauct

SEQ ID NO: 1418 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaguugguugaacaguuauuucugca

SEQ ID NO: 1419 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaagaccucucagguauuguaaggg

SEQ ID NO: 1420 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaagcucagauauuugggcuucaag

SEQ ID NO: 1421 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagugcuguaucaucccaaauguca

SEQ ID NO: 1422 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucauucaucagcuguguguucugaat

SEQ ID NO: 1423 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccaguccccagguaauguaaaugua

SEQ ID NO: 1424 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuucuaguaauuugggaaugccug

SEQ ID NO: 1425 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuagguuucaugcucauauccgguc

SEQ ID NO: 1426 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugauccucagugguuugaacaguc

SEQ ID NO: 1427 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucgucuccucugaaaugucauuc

SEQ ID NO: 1428 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccaucucuuuaucggagucucuut

SEQ ID NO: 1429 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaagucaaauauuugccucuccag

SEQ ID NO: 1430 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaaggcauuucgcucaacacuuuuc

SEQ ID NO: 1431 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucauauggcuaucccuuugcaauuc

SEQ ID NO: 1432 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccauacugcucaaccucugcaaua

SEQ ID NO: 1433 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccauuucugagaucaggucugaca

SEQ ID NO: 1434 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuagcuguagcacaaaaucuucgt

SEQ ID NO: 1435 - DNA, 58 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugacaccaacaucuuuacugcagaa

SEQ ID NO: 1436 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuuggaugaauggaggugaggaaut

SEQ ID NO: 1437 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugcgcuuguuauacucuuuagugc

SEQ ID NO: 1438 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaagacucggaugauguaccuaugg

SEQ ID NO: 1439 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccugacccaagaugaaauaaaacguc

SEQ ID NO: 1440 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagagccuaaacauccccuuaaauugg

SEQ ID NO: 1441 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggugugaaaugacugaguacaaacug

SEQ ID NO: 1442 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcucacagaaaugucugcuauacuga

SEQ ID NO: 1443 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagacugcuaaggcauaggaauuuucg

SEQ ID NO: 1444 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugguaauagucggugcuguagauaucc

SEQ ID NO: 1445 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguucaaaugaguagacacagcuugag

SEQ ID NO: 1446 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaccagauagaacagacacagcuact

SEQ ID NO: 1447 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaagaugcagagcucugaguagaac

SEQ ID NO: 1448 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugcuugaagaucagaaguuccaaug

SEQ ID NO: 1449 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucauaggcaagaagauggaacagauga

SEQ ID NO: 1450 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagauggagaugaugaagaugauuggg

SEQ ID NO: 1451 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaagagaaaaggagauuacagcuuccc

SEQ ID NO: 1452 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaaaccugucucuuggauauucucg

SEQ ID NO: 1453 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccaaauauccccaguuuccagaauc

SEQ ID NO: 1454 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucuacuuccaucuugucaggaggac

SEQ ID NO: 1455 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucuucucaaagucgucauccuuca

SEQ ID NO: 1456 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucacagaguucaagcugaagaagat

SEQ ID NO: 1457 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcugaaacaaaaagcacucuucuguc

SEQ ID NO: 1458 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaugauggaugucacguucucaaag

SEQ ID NO: 1459 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugugaguggauggguaaaaccuat

SEQ ID NO: 1460 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacagcagucuuucuuucccauguaa

SEQ ID NO: 1461 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagccucuugcucaguuuuaucuaagg

SEQ ID NO: 1462 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucucuuuagggagcuucucuucuucc

SEQ ID NO: 1463 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccagagaaaagagaguuacucacac

SEQ ID NO: 1464 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaccuugucuugauuuuacuuuccc

SEQ ID NO: 1465 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuaaugaauucuucuuccugcucag

SEQ ID NO: 1466 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagugaucagaggucuugacauauugg

SEQ ID NO: 1467 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauaaaucagggagucagauggagugg

SEQ ID NO: 1468 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacugacggaaguucucauaaacguc

SEQ ID NO: 1469 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucacuuugaccaaagucucacugacaa

SEQ ID NO: 1470 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucuucaaaguugcaguaaaaaccc

SEQ ID NO: 1471 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccuuucacgaauucauuuucuuugcg

SEQ ID NO: 1472 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuaucacauuguucucuccaaugcag

SEQ ID NO: 1473 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucucguacaagucacaaaguguaucca

SEQ ID NO: 1474 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugacagacuucucucacacauuguguc

SEQ ID NO: 1475 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagagugcaguaucaagaaucuuguc

SEQ ID NO: 1476 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugagauaguuucacuuucuucccagct

SEQ ID NO: 1477 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugccaucuccucuugcauaaacaagut

SEQ ID NO: 1478 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugguggaaaguaauagucaaugggcaa

SEQ ID NO: 1479 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugucuucccaacaaauuuugggugaaa

SEQ ID NO: 1480 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucaucaucaucaucaucauccuccga

SEQ ID NO: 1481 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugaugcuuuguuaaugcgaaguucug

SEQ ID NO: 1482 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguuguacacuuugaggagugaucug

SEQ ID NO: 1483 - DNA, 59 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuugugaacaguucuucuggaucag

SEQ ID NO: 1484 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaccagacagaaaauuuccacauaagc

SEQ ID NO: 1485 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugggacacaauuugacaaauaugacca

SEQ ID NO: 1486 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuagcacaguuuaaaaaugaggccuact

SEQ ID NO: 1487 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugauucuuauaaagugcagcuucugcat

SEQ ID NO: 1488 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuguguggaagauccaauccauuuuug

SEQ ID NO: 1489 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugaaacuaaaaauccuuugcaggacug

SEQ ID NO: 1490 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccauacucuaccacauauagguccut

SEQ ID NO: 1491 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcuucuuugaguuuguaucuuggaugc

SEQ ID NO: 1492 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguggaguauuuggaugacagaaacac

SEQ ID NO: 1493 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaugaaccguucugagaugaauuagga

SEQ ID NO: 1494 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugaucuacagaguuccaaaagugaca

SEQ ID NO: 1495 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuugauuucuuuuacugacccuucugc

SEQ ID NO: 1496 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaagauuuucaaucuccucuuggguug

SEQ ID NO: 1497 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucuuugugcuuacuccuuccuagut

SEQ ID NO: 1498 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggaaauguuuccuagacaaacucguca

SEQ ID NO: 1499 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguggaauuggaauggauuuugaaggag

SEQ ID NO: 1500 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggaagaucuuaacuucccuuucaaga

SEQ ID NO: 1501 - DNA, 60 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucugguugagagauuugguauuuggt

SEQ ID NO: 1502 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguguacguuugucaguuauuauagugcc

SEQ ID NO: 1503 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaaucuccaggccuaacauaauuucag

SEQ ID NO: 1504 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacacaugaagccaucguauauauucaca

SEQ ID NO: 1505 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucagcucagaauuaaccauaaaacuggug

SEQ ID NO: 1506 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucauaccuaccucugcaauuaaauuugg

SEQ ID NO: 1507 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauugauuguuucuaauagagcagccaga

SEQ ID NO: 1508 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguagacuuggaaucuacugauauccct

SEQ ID NO: 1509 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaauaaaggacccauuagaaccaacucc

SEQ ID NO: 1510 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuagaaugccaguuaaugaaaacagaacg

SEQ ID NO: 1511 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugaagacagauggcucauucauaggaua

SEQ ID NO: 1512 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaauuccucuugacuauucuacagcaaa

SEQ ID NO: 1513 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaagaaugaaaagucuucaacacuugg

SEQ ID NO: 1514 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauccagaaauguuuugguaacagaaaacaa

SEQ ID NO: 1515 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaagcaucagcauuugacuuuaccuuauc

SEQ ID NO: 1516 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaaucuccauuuuagcacuuaccuguga

SEQ ID NO: 1517 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaguuuuuccaagaaccaaguucuucc

SEQ ID NO: 1518 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaucuuccaccuuaaauucugguucugua

SEQ ID NO: 1519 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaucaacucaugaauuagcugguuucga

SEQ ID NO: 1520 - DNA, 61 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucuucaauggcuuuagucuguuccaa

SEQ ID NO: 1521 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuggagagagaacaaauaaaugguuaccug

SEQ ID NO: 1522 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuauuuucagccuucuacuagucgaaagcg

SEQ ID NO: 1523 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaauccaaaucauauaccaaagcaucca

SEQ ID NO: 1524 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacuuuuaacacuucaccuuuaacugcuuc

SEQ ID NO: 1525 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucguugaugauuucuaaccuuuucugguut

SEQ ID NO: 1526 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucugguuucuguagaauuccaugaguagut

SEQ ID NO: 1527 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcucugguagaauugacauaucucaacac

SEQ ID NO: 1528 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggagauauuucaccugacuugauucaagg

SEQ ID NO: 1529 - DNA, 62 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuuuucuggauaaaaagagccacuguuc

SEQ ID NO: 1530 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauacaacccacugagguauauguauagguaut

SEQ ID NO: 1531 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaaaaucaaagcauucuuaccuuacuaca

SEQ ID NO: 1532 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucccagagaacaaauuaaaagaguuaagga

SEQ ID NO: 1533 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugcuucuuuaaauaguucaugcuuuauggut

SEQ ID NO: 1534 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuccgaauauagagaaccucaaucucuuugt

SEQ ID NO: 1535 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaaugcuuuuaaauaugucauugugggcat

SEQ ID NO: 1536 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguacaacagauuaucucugaauuagagcga

SEQ ID NO: 1537 - DNA, 63 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuagauaaugcuuaauauucacuuccccgug

SEQ ID NO: 1538 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuuuuccaguuuauuguauuugcauagcaca

SEQ ID NO: 1539 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaucuacuguuuuccuuuacuuacuacacct

SEQ ID NO: 1540 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaauauagaaccuaauggaaggauuuggug

SEQ ID NO: 1541 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauggguauggcauauauccaagagaaaagauut

SEQ ID NO: 1542 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaccuugcuaagagauauucaucugucuuuuc

SEQ ID NO: 1543 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauauucugaucugguugaacuauuacuuuucca

SEQ ID NO: 1544 - DNA, 64 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucccuucuuaaauugcuccuguaucauugaut

SEQ ID NO: 1545 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaagaauaugaaaagaugauuugagauggug

SEQ ID NO: 1546 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugguuaguauguuaucauuugggaaaccaaaut

SEQ ID NO: 1547 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauaaaaucuguuuuccaauaaauucucagaucca

SEQ ID NO: 1548 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuagauaugguuaagaaaacuguuccaauaca

SEQ ID NO: 1549 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauagaauaggauauuguaucauaccaauuucucg

SEQ ID NO: 1550 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugaauuaaacacacaucacauacauacaaguca

SEQ ID NO: 1551 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugucuguguaaucaaacaaguuuauauuuccc

SEQ ID NO: 1552 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuucccuuuuguacugaauuuuagauuacugat

SEQ ID NO: 1553 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuggaagcuuuaacuucuuuauuaaguucuuc

SEQ ID NO: 1554 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucuguucaagaacuucugaauuuaaaacaguct

SEQ ID NO: 1555 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuaguaaguaugaaacuuguuucugguauccaa

SEQ ID NO: 1556 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauucuuuggcacaauauuaacuagucuauuguag

SEQ ID NO: 1557 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauugucugauauucuuucucauauuucuucagct

SEQ ID NO: 1558 - DNA, 65 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuugcucuuuugauucuuuaaauacaucaaagt

SEQ ID NO: 1559 - DNA, 66 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauguuauauugaaaaugauuaacauguagaagggc

SEQ ID NO: 1560 - DNA, 66 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuuaagugacauaccaauuuguacaacaguuauc

SEQ ID NO: 1561 - DNA, 66 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaucaacaugcugauucuuuucaacguuuuauuuuc

SEQ ID NO: 1562 - DNA, 66 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgaugugguauucugucuuuaauuguaagauaugcaa

SEQ ID NO: 1563 - DNA, 66 bp, Artificial
  synthetic primer sequence
  misc_feature (21)..(23): n is a, c, g, t or u
  misc_feature (27)..(29): n is a, c, g, t or u
tgacaaggcgtagtcacggunnnactnnntgauuguuccugugucaacuuaaucauuuguuugaua

SEQ ID NO: 1564 - DNA, 49 bp, artificial sequence
  synthetic primer sequence
  misc_feature (21)..(23): n is a, c, g, t or u
  misc_feature (27)..(29): n is a, c, g, t or u
  X (34)..(49): each individually A, C, G, T or U
  misc_feature (34)..(49): n is a, c, g, t or u
tctgtacggtgacaaggcgunnnactnnntgaunnnnnnnnnnnnnnnn

SEQ ID NO: 1565 - DNA, 49 bp, artificial
  synthetic primer sequence
  misc_feature (21)..(23): n is a, c, g, t or u
  misc_feature (27)..(29): n is a, c, g, t or u
  X (34)..(49): each X independently is A, C, G, T or U
  misc_feature (34)..(49): n is a, c, g, t or u
tgacaaggcgtagtcacggunnnactnnntgaunnnnnnnnnnnnnnnn

SEQ ID NO: 1566 - DNA, 19 bp, artificial
  synthetic universal handle sequence
tctgtacggtgacaaggcg

SEQ ID NO: 1567 - DNA, 19 bp, artificial
  synthetic universal handle sequence
tgacaaggcgtagtcacgg

What is claimed:

1. A composition for a single stream multiplex determination of actionable oncology biomarkers in a sample, the composition comprising a plurality of sets of primer pair reagents directed to a plurality of target sequences to detect low level targets in the sample, wherein the target genes consist of the following functions: DNA hotspot mutation genes, copy number variation (CNV) genes, inter-genetic fusion genes, and intra-genetic fusion genes; and wherein the plurality of sets of primer pair reagents includes the primers of SEQ ID NO:1-SEQ ID NO:1563.

2. The composition of claim 1 wherein one or more actionable target genes in a sample determines a change in oncology activity in the sample indicative of a potential diagnosis, prognosis, candidate therapeutic regimen, and/or adverse event.

3. The composition of claim 1 wherein the target genes consist of AKT1, AKT2, AKT3, ALK, AR, ARAF, BRAF, CDK4, CD274, CDKN2A, CHEK2, CTNNB1, EGFR, ERBB2, ERBB3, ERBB4, ESR1, FGFR1, FGFR2, FGFR3, FGFR4, FLT3, GNA11, GNAQ, GNAS, HRAS, IDH1, IDH2, KIT, KRAS, MET, MTOR, NRAS, NRG1, NTRK1, NTRK2, NTRK3, NUTM1, PDGFRA, PIK3CA, PTEN, RAF1, RET, ROS1, RSPO2, RSPO3, SMO, and TP53.

4. The composition of claim 1 wherein the plurality of target sequences comprise the amplicon sequences detected by the primers of SEQ ID NO:1-SEQ ID NO:1563.

5. The composition of claim 1 wherein the plurality of target sequences consist of each of the amplicon sequences detected by the primers of SEQ ID NO:1-SEQ ID NO:1563.

6. The composition of claim 1 wherein the plurality of sets of primer pair reagents consist of each of the primers of SEQ ID NO:1-SEQ ID NO:1563.

7. A multiplex assay comprising the composition of claim 4.

8. A test kit comprising the composition of claim 4.

* * * * *